US006759515B1

(12) United States Patent
Xu et al.

(10) Patent No.: US 6,759,515 B1
(45) Date of Patent: Jul. 6, 2004

(54) COMPOSITIONS AND METHODS FOR THE THERAPY AND DIAGNOSIS OF PROSTATE CANCER

(75) Inventors: Jiangchun Xu, Bellevue, WA (US); Davin C. Dillon, Issaquah, WA (US); Jennifer L. Mitcham, Redmond, WA (US); Susan L. Harlocker, Seattle, WA (US); Yuqiu Jiang, Kent, WA (US); Michael D. Kalos, Seattle, WA (US); Gary R. Fanger, Mill Creek, WA (US); Marc W. Retter, Carnation, WA (US); John A. Stolk, Bothell, WA (US); Craig H. Day, Seattle, WA (US); Thomas S. Vedvick, Federal Way, WA (US); Darrick Carter, Seattle, WA (US); Samuel X. Li, Redmond, WA (US); Aijun Wang, Issaquah, WA (US); Yasir A. W. Skeiky, Bellevue, WA (US); William T. Hepler, Seattle, WA (US); Robert A. Henderson, Edmonds, WA (US)

(73) Assignee: Corixa Corporation, Seattle, WA (US)

( * ) Notice: Subject to any disclaimer, the term of this patent is extended or adjusted under 35 U.S.C. 154(b) by 0 days.

(21) Appl. No.: 09/679,426

(22) Filed: Oct. 2, 2000

Related U.S. Application Data

(63) Continuation-in-part of application No. 09/657,279, filed on Sep. 6, 2000, which is a continuation-in-part of application No. 09/651,236, filed on Aug. 29, 2000, which is a continuation-in-part of application No. 09/636,215, filed on Aug. 9, 2000, which is a continuation-in-part of application No. 09/605,783, filed on Jun. 27, 2000, which is a continuation-in-part of application No. 09/593,793, filed on Jun. 13, 2000, which is a continuation-in-part of application No. 09/570,737, filed on May 12, 2000, which is a continuation-in-part of application No. 09/568,100, filed on May 9, 2000, which is a continuation-in-part of application No. 09/536,857, filed on Mar. 27, 2000, which is a continuation-in-part of application No. 09/483,672, filed on Jan. 14, 2000, which is a continuation-in-part of application No. 09/443,686, filed on Nov. 18, 1999, which is a continuation-in-part of application No. 09/439,313, filed on Nov. 12, 1999, which is a continuation-in-part of application No. 09/352,616, filed on Jul. 13, 1999, which is a continuation-in-part of application No. 09/288,946, filed on Apr. 9, 1999, which is a continuation-in-part of application No. 09/232,149, filed on Jan. 15, 1999, which is a continuation-in-part of application No. 09/159,812, filed on Sep. 23, 1998, which is a continuation-in-part of application No. 09/115,453, filed on Jul. 14, 1998, which is a continuation-in-part of application No. 09/030,607, filed on Feb. 25, 1998, which is a continuation-in-part of application No. 09/020,956, filed on Feb. 9, 1998, which is a continuation-in-part of application No. 08/904,804, filed on Aug. 1, 1997, now abandoned, which is a continuation-in-part of application No. 08/806,099, filed on Feb. 25, 1997, now abandoned.

(51) Int. Cl.[7] .............................................. C07K 14/00

(52) U.S. Cl. .................. 530/350; 514/2; 424/192.1; 435/6

(58) Field of Search .......................... 435/6; 530/350; 514/2; 424/192.1

(56) References Cited

U.S. PATENT DOCUMENTS

| 5,786,148 A |   | 7/1998 | Bandman et al. |
| 6,107,090 A | * | 8/2000 | Bander |
| 6,136,311 A | * | 10/2000 | Bander |

FOREIGN PATENT DOCUMENTS

| EP | 317 141 A2 | 5/1989 |
| EP | 652 014 A1 | 5/1995 |
| WO | WO 93/14755 | 8/1993 |
| WO | WO 93/25224 | 12/1993 |
| WO | WO 94/09820 | 5/1994 |
| WO | WO 95/04548 | 2/1995 |
| WO | WO 95/30758 | 11/1995 |
| WO | WO 96/21671 | 7/1996 |
| WO | WO 97/31111 | 8/1997 |
| WO | WO 97/33909 | 9/1997 |
| WO | WO 98/12302 | 3/1998 |
| WO | WO 98/17687 | 4/1998 |
| WO | WO 98/20117 | 5/1998 |
| WO | WO 98/20165 | 5/1998 |
| WO | WO 98/31799 | 7/1998 |
| WO | WO 98/37093 | 8/1998 |
| WO | WO 98/37418 | 8/1998 |
| WO | WO 98/38310 | 9/1998 |
| WO | WO 98/39446 | 9/1998 |
| WO | WO 98/45435 | 10/1998 |
| WO | WO 98/50567 | 11/1998 |
| WO | WO 99/06548 | 2/1999 |
| WO | WO 99/06552 | 2/1999 |
| WO | WO 99/25825 | 5/1999 |
| WO | WO 99/31236 | 6/1999 |
| WO | WO 99/49735 | 10/1999 |
| WO | WO 00/04149 | 1/2000 |
| WO | WO 00/18912 | 4/2000 |

(List continued on next page.)

OTHER PUBLICATIONS

Small, 2000, "Immunotherapy of hormone–refractory prostate cancer with antigen–loaded dendritic cells" journal of clinical oncology, vol. 18, No. 23, pp. 3894–3903.*

(List continued on next page.)

*Primary Examiner*—Brenda Brumback
*Assistant Examiner*—Roy Teller
(74) *Attorney, Agent, or Firm*—Seed IP Law Group PLLC

(57) ABSTRACT

Compositions and methods for the therapy and diagnosis of cancer, particularly prostate cancer, are disclosed. Illustrative compositions comprise one or more prostate-specific polypeptides, immunogenic portions thereof, polynucleotides that encode such polypeptides, antigen presenting cell that expresses such polypeptides, and T cells that are specific for cells expressing such polypeptides. The disclosed compositions are useful, for example, in the diagnosis, prevention and/or treatment of diseases, particularly prostate cancer.

2 Claims, 14 Drawing Sheets

FOREIGN PATENT DOCUMENTS

| WO | WO 00/55174 | 9/2000 |
|---|---|---|
| WO | WO 00/58471 | 10/2000 |
| WO | WO 01/25272 | 4/2001 |
| WO | WO 01/34802 | 5/2001 |
| WO | WO 01/51633 | 7/2001 |
| WO | WO 01/57058 | 8/2001 |

OTHER PUBLICATIONS

Lee, 1998, "Isolation of Moat–B, a widely expressed multidrug resustance–associated protein/canalicular multispecific organic anion transporter–related transporter" cancer research, 58, pp. 2741–2747.*

Kool, 1997, "Analysis of Expression of cMoat (MRP2), MRP3, MRP4, and MRP5, Homologues of the multidrug resistance–associated protein gene (MRP1) in human cancer cell lines" cancer research, 57, pp. 3537–3547.*

Ahn and Kunkel, "The structural and functional diversity of dystrophin," *Nature Genetics 3:* 283–291, Apr. 1993.

Alexeyev et al., "Improved antibiotic–resistance gene cassettes and omega elements for *Escherichia coli* vector construction and in vitro deletion/insertion mutagenesis," *Gene 160*:63–67, 1995.

Berthon et al. "Predisposing gene for early–onset prostate cancer, localized on chromosome 1q42.2–43," *Am. J. Hum. Genet. 62*(6):1416–1424, Jun. 1998.

Blok et al., "Isolation of cDNA that are differentially expressed between androgen–dependent and androgen–independent prostate carcinoma cells using differential display PCR," *The Prostate 26*:213–224, 1995.

Busselmakers et al., Genbank Accession No. AF103907, Aug. 14, 2000.

Busselmakers et al., Genbank Accession No. AF103908, Aug. 14, 2000.

Cawthon et al., "cDNA sequence and genomic structure of EV12B, a gene lying within an intron of the neurofibromatosis type 1 gene," *Genomics 9*:446–460, 1991.

Chu et al., "CpG oligodeoxynucleotides act as adjuvants that switch on T helper 1 (Th1) immunity," *J. Exp. Med. 186*(10): 1623–1631, Nov. 17, 1997.

Coleman et al., *Fundamental Immunology*, Wm. C. Brown Publishers, Dubuque, Iowa, 1989, pp. 465–466.

Database EMBL Accesion No. AA453562, Jun. 11, 1997, Hillier et al., *"Homo sapiens* cDNA clone 788180."

Derwent Geneseq Database, Accession No. V58522, Dec. 8, 1998.

Derwent Geneseq Database, Accession No. V61287, Jan. 6, 1999.

Duerst and Nees, "Nucleic acid characteristic of late or early passage cells immortalized by papilloma virus–and related polypeptide(s) and antibodies, used for diagnosis and treatment of cervical cancer and assessing potential for progression of cervical lesions," Derwent World Patent Index, Accession No. 1998–121623, 1998. See also German Patent DE 19649207 C1.

El–Shirbiny, Prostatic Specific Antigen, *Advances In Clinical Chemistry 31*:99–133, 1994.

Ezzell, C., "Cancer vaccines: an idea whose time has come?" *The Journal of NIH Research 7*:46–49, Jan., 1995.

Hara et al., "Characterization of cell phenotype by a novel cDNA library subtraction system: expression of $CD8\alpha$ in a mast cell–derived interleukin–4–dependent cell line," *Blood 84*(1):189–199, Jul. 1, 1994.

Harris et al., "Polycystic Kidney Disease 1: identification and analysis of the primary defect," *J. Am. Soc. of Nephrol.* 6:1125–1133, 1995.

Hillier et al., Genbank Accession No. AA100799, Dec. 23, 1997.

Hillier et al., Genbank Accession No. R20590, Apr. 18, 1995.

Hudson, T., Genbank Accession No. G22461, May 31, 1996.

Kroger, B. "New serine protease form human prostate, useful for identifying specific inhibitors, antibodies and probes," Derwent World Patent Index, Accession No. 99–432218, 1999. See also European Patent EP 936 270 A2.

Lalvani et al., "Rapid effector function of $CD8^+$ memory cells," *J. Exp. Med. 186*:859–865, Sep. 15, 1997.

National Cancer Institute, Cancer Genome Anatomy Project (NCI–CGAP), Genbank Accession No. AA551449, Sep. 5, 1997.

National Cancer Institute, Cancer Genome Anatomy Project (NCI–CGAP), Genbank Accession No. AA551759, Aug. 11, 1997.

National Cancer Institute, Cancer Genome Anatomy Project (NCI–CGAP), Genbank Accession No. AA631143, Oct. 31, 1997.

National Cancer Institute, Cancer Genome Anatomy Project (NCI–CGAP), Genbank Accession No. AA653016, Nov. 25, 1997.

Nelson et al., Genbank Accession No. NP_004908, Mar. 18, 2000.

Robson et al., "Identification of prostatic adrogen regulated genes using the differential display technique," *Proceedings of the American Association for Cancer Research Meeting 86,* 36:p.266, Abstract No. 1589,1995.

Schena et al., "Parallel human genome analysis: Microarray–based monitoring of 1000 genes," *Proc. Natl. Acad. Sci. USA 93*(19):10614–10619, Sep. 17, 1996.

Sherman et al., "Selecting T cell receptors with high affinity for self–MHC by decreasing the contribution of CD8," *Science 258*(5083):815–818, Oct. 30, 1992.

Short et al., "λ ZAP: a bacteriophage λ expression vector with in vivo excision properties," *Nucleic Acids Research 16*(15):7583–7600, 1988.

Sjögren, H., "Terapeutic Immunization Against Cancer Antigens Using Genetically Engineered Cells," *Immunotechnology 3*: 161–172, 1997.

Theobald, et al., "Targeting p53 as a general tumor antigen," *Proc. Natl. Sci. USA 92*(25):11993–11997, Dec. 5, 1995.

Tusnady and Simon, "Principles governing amino acid compositions of integral membrane proteins: application to topology prediction," *J. Mol. Biol. 283*(2):489–506, Oct. 23, 1998.

Van Tsai et al., "In vitro immunization and expansion of antigen–specific cytotoxic T lymphocytes for adoptive immunotherapy using peptide–pulsed dendritic cells," *Critical Reviews in Immunology 18*:65–75, 1998.

Vasmatzis et al., "Discovery of three genes specifically expressed in human prostate by expressed sequence tag database analysis," *Proc. Natl. Acad. Sci. USA 95*(1):300–304, Jan. 6, 1998.

Yee et al., "Isolation of tyrosinase–specific $CD8^+$ and $CD4^+$ T cell clones from the peripheral blood of melanoma patients following in vitro stimulation with recombinant vaccinia virus," *The Journal of Immunology 157*(9):4079–4086, Nov. 1, 1996.

Zitvogel et al., "Eradication of Established Murine Tumors Using a Novel Cell–Free Vaccine: Dendritic Cell–Derived Exosomes," *Nature Medicine* 4(5): 594–600, May, 1998.

GenBank Accession No. AF047020, Feb. 1, 1999.

Schmidt–Wolf et al., "Activated T cells and cytokine–induced $CD3^+$ $CD56^+$ killer cells," *Annals of Hematology* 74:51–56, 1997.

Genseq Database (Thomson Derwent), Accession No. AAB56975, Mar. 13, 2001.

Genseq Database (Thomson Derwent), Accession No. AAF16178, Mar. 13, 2001.

Genseq Database (Thomson Derwent), Accession No. AAH81778, Sept. 21, 2001.

Genseq Database (Thomson Derwent), Accession No. AAX40493, Jun. 18, 1999.

GenBank Database, Accession No. AF071203, Jul 21, 1998.

GenBank Database, Accession No. AF339763, Apr 2, 2001.

GenBank Database, Accession No. AL139381, Oct 12, 2001.

Genbank Database, Accession No. CAC36037, Apr. 4, 2001.

GenBank Database, Accession No. CAD24440, Feb. 22, 2002.

GenBank Database, Accession No. NM005845, Jun 10, 1999.

GenBank Database, Accession No. NP005836, Jun 10, 1999.

GenBank Database, Accession No. U66682, Jul 13, 1999.

GenBank Database, Accession No. U66686, Jul 13, 1999.

GenBank Database, Accession No. U83660, Sept 27, 1997.

GenBank Database, Accession No. XM007206, Nov 16, 2000.

GenBank Database, Accession No. XP007206, Nov 16, 2000.

GenBank Database, Accession No. AAB71757, Sept 26, 1997.

GenBank Database, Accession No. AAC27076, Jul 21, 1998.

GenBank Database, Accession No. AAC27077, Jul 21 1998.

GenBank Database, Accession No. AF071202, Jul 21, 1998.

\* cited by examiner

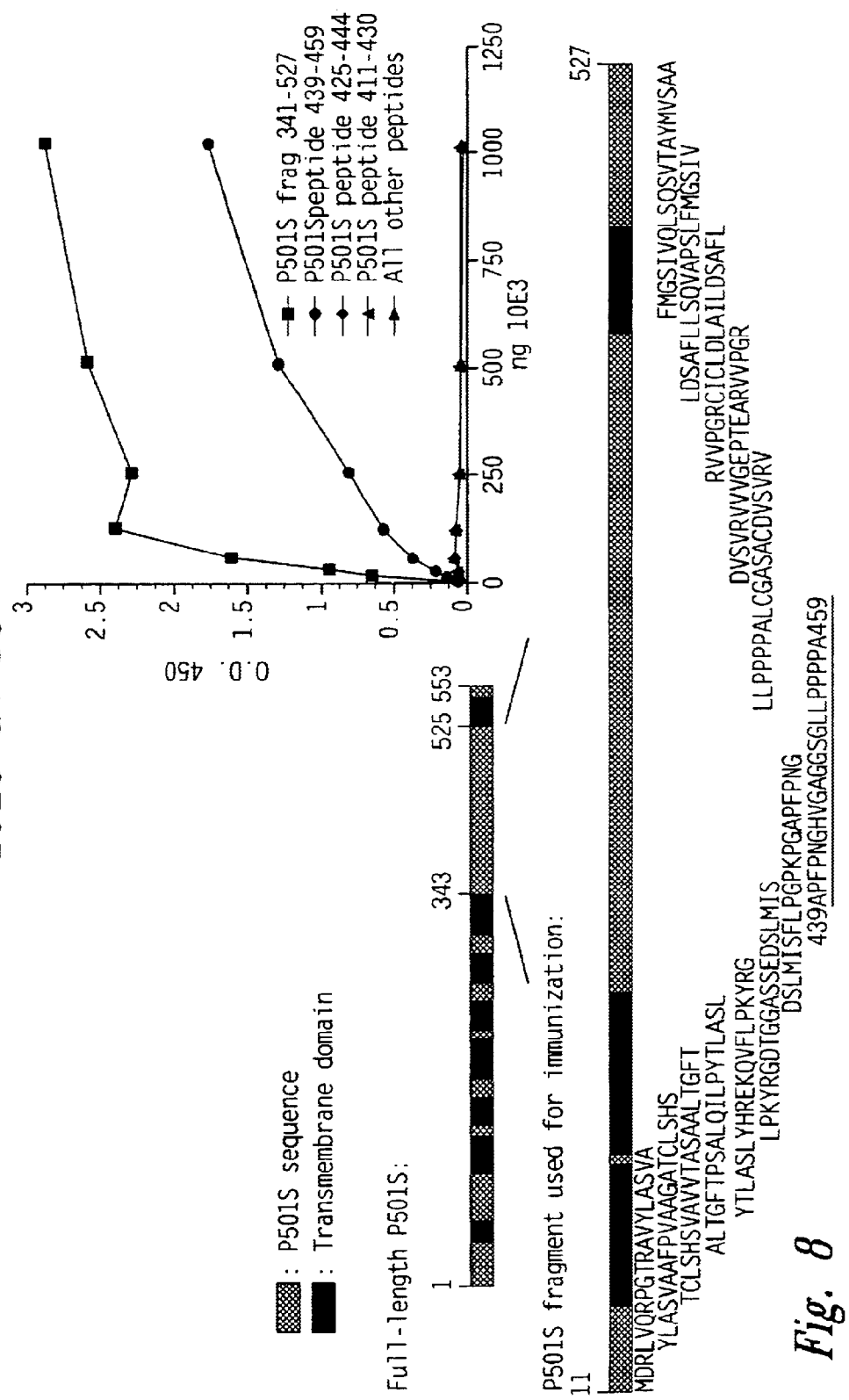
FIGURE 8. Mapping of the epitope recognized by 10E3-G4-D3

Schematic of P501S with predicted transmembrane, cytoplasmic, and extracellular regions

*MVQRLWVSRLLRHRK* AQLLLVNLLTFGLEVCLAAGIT YVPPLLLEVGVEEKFM
TMVLGIGPVLGLVCYPLLGSAS

*DHWRGRYGRRRP* FIWALSLGILLSLFLIPRAGWL AGLLCPDPRPLE LALLILGVGLLDFCGQVCFTPL

*EALLSDLFRDPDHCRQ* AYSVYAFMISLGGCLGYLLPAI DWDTSALAPYLGTQEE

CLFGLLTLIFLTCVAATLLV *AEEAALGPTEPAEGLSAPSLSPHCCPCRARLAFRNLGALLPRL*

*HQLCCRMPRTLRR* LFVAELCSWMALMTFTLFYTDF VGEGLYQGVPRAEPGTEARRHYDEGVR

MGSLGLFLQCAISLVFSLVM *DRLVQRFGTRAVYLAS* VAAFPVAAGATCLSHSVAVVTA SAA

LTGFTFSALQILPYTLASLY *HREKQVFLPKYRGDTGGASSEDSLMTSFLPGPKPGAPFPNGHVGAGGSGL*

*LPPPPALCGASACDVSVRVVVGEPTEARVVPGRG* ICLDLAILDSAFLLSQVAPSLF MGSIVQLSQS

VTAYMVSAAGLGLVAIYFAT *QVVFDKSDLAKYSA*

Underlined sequence: Predicted transmembrane domain; Bold sequence: Predicted extracellular domain; *Italic sequence*: Predicted intracellular domain. Sequence in bold/underlined: used generate polyclonal rabbit serum Localization of domains predicted using HMMTOP (G.E. Tusnady an I. Simon (1998) Principles Governing Amino Acid Composition of Integral Membrane Proteins: Applications to topology Prediction.J.Mol Biol. 283, 489-506.

*Fig. 9*

```
GTCACTTAGG AAAAGGTGTC CTTTCGGGCA GCCGGGCTCA GCATGAGGAA CAGAAGGAAT   60
GACACTCTGG ACAGCACCCG GACCCTGTAC TCCAGCGCGT CTCGGAGCAC AGACTTGTCT  120
TACAGTGAAA GCGACTTGGT GAATTTTATT CAAGCAAATT TTAAGAAACG AGAATGTGTC  180
TTCTTTACCA AAGATTCCAA GGCCACGGAG AATGTGTGCA AGTGTGGCTA TGCCCAGAGC  240
CAGCACATGG AAGGCACCCA GATCAACCAA AGTGAGAAAT GGAACTACAA GAAACACACC  300
AAGGAATTTC CTACCGACGC CTTTGGGGAT ATTCAGTTTG AGACACTGGG GAAGAAAGGG  360
AAGTATATAC GTCTGTCCTG CGACACGGAC GCGGAAATCC TTTACGAGCT GCTGACCCAG  420
CACTGGCACC TGAAAACACC CAACCTGGTC ATTTCTGTGA CCGGGGGCGC CAAGAACTTC  480
GCCCTGAAGC CGCGCATGCG CAAGATCTTC AGCCGGCTCA TCTACATCGC GCAGTCCAAA  540
GGTGCTTGGA TTCTCACGGG AGGCACCCAT TATGGCCTGA CGAAGTACAT CGGGGAGGTG  600
GTGAGAGATA ACACCATCAG CAGGAGTTCA GAGGAGAATA TTGTGGCCAT TGGCATAGCA  660
GCTTGGGGCA TGGTCTCCAA CCGGGACACC CTCATCAGGA ATTGCGATGC TGAGGGCTAT  720
TTTTTAGCCC AGTACCTTAT GGATGACTTC ACAAGGGATC CACTGTATAT CCTGGACAAC  780
AACCACACAC ATTTGCTGCT CGTGGACAAT GGCTGTCATG ACATCCCAC TGTCGAAGCA  840
AAGCTCCGGA ATCAGCTAGA GAAGCATATC TCTGAGCGCA CTATTCAAGA TTCCAACTAT  900
GGTGGCAAGA TCCCCATTGT GTGTTTTGCC CAAGGAGGTG GAAAAGAGAC TTTGAAAGCC  960
ATCAATACCT CCATCAAAAA TAAAATTCCT TGTGTGGTGG TGGAAGGCTC GGGCCGGATC 1020
GCTGATGTGA TCGCTAGCCT GGTGGAGGTG GAGGATGCCC CGACATCTTC TGCCGTCAAG 1080
GAGAAGCTGG TGCGCTTTTT ACCCCGCACG GTGTCCGGC TGTCTGAGGA GGAGACTGAG 1140
AGTTGGATCA AATGGCTCAA AGAAATTCTC GAATGTTCTC ACCTATTAAC AGTTATTAAA 1200
ATGGAAGAAG CTGGGGATGA AATTGTGAGC AATGCCATCT CCTACGCTCT ATACAAAGCC 1260
TTCAGCACCA GTGAGCAAGA CAAGGATAAC TGGAATGGGC AGCTGAAGCT TCTGCTGGAG 1320
TGGAACCAGC TGGACTTAGC CAATGATGAG ATTTTCACCA ATGACCGCCG ATGGGAGTCT 1380
GCTGACCTTC AAGAAGTCAT GTTTACGGCT CTCATAAAGG ACAGACCCAA GTTTGTCCGC 1440
CTCTTTCTGG AGAATGGCTT GAACCTACGG AAGTTTCTCA CCCATGATGT CCTCACTGAA 1500
CTCTTCTCCA ACCACTTCAG CACGCTTGTG TACCGGAATC TGCAGATCGC CAAGAATTCC 1560
TATAATGATG CCCTCCTCAC GTTTGTCTGG AAACTGGTTG CGAACTTCCG AAGAGGCTTC 1620
CGGAAGGAAG ACAGAAATGG CCGGGACGAG ATGGACATAG AACTCCACGA CGTGTCTCCT 1680
ATTACTCGGC ACCCCCTGCA AGCTCTCTTC ATCTGGGCCA TTCTTCAGAA TAAGAAGGAA 1740
CTCTCCAAAG TCATTTGGGA GCAGACCAGG GGCTGCACTC TGGCAGCCCT GGGAGCCAGC 1800
AAGCTTCTGA AGACTCTGGC CAAAGTGAAG AACGACATCA ATGCTGCTGG GGAGTCCGAG 1860
GAGCTGGCTA ATGAGTACGA GACCCGGGCT GTTGAGCTGT TCACTGAGTG TTACAGCAGC 1920
GATGAAGACT TGGCAGAACA GCTGCTGGTC TATTCCTGTG AAGCTTGGGG TGGAAGCAAC 1980
TGTCTGGAGC TGGCGGTGGA GGCCACAGAC CAGCATTTCA CCGCCCAGCC TGGGGTCCAG 2040
AATTTTCTTT CTAAGCAATG GTATGGAGAG ATTTCCCGAG ACACCAAGAA CTGGAAGATT 2100
```

*Fig. 12A (1)*

```
ATCCTGTGTC TGTTTATTAT ACCCTTGGTG GGCTGTGGCT TTGTATCATT TAGGAAGAAA 2160
CCTGTCGACA AGCACAAGAA GCTGCTTTGG TACTATGTGG CGTTCTTCAC CTCCCCCTTC 2220
GTGGTCTTCT CCTGGAATGT GGTCTTCTAC ATCGCCTTCC TCCTGCTGTT TGCCTACGTG 2280
CTGCTCATGG ATTTCCATTC GGTGCCACAC CCCCCCGAGC TGGTCCTGTA CTCGCTGGTC 2340
TTTGTCCTCT TCTGTGATGA AGTGAGACAG TGGTACGTAA ATGGGGTGAA TTATTTTACT 2400
GACCTGTGGA ATGTGATGGA CACGCTGGGG CTTTTTTACT TCATAGCAGG AATTGTATTT 2460
CGGCTCCACT CTTCTAATAA AAGCTCTTTG TATTCTGGAC GAGTCATTTT CTGTCTGGAC 2520
TACATTATTT TCACTCTAAG ATTGATCCAC ATTTTTACTG TAAGCAGAAA CTTAGGACCC 2580
AAGATTATAA TGCTGCAGAG GATGCTGATC GATGTGTTCT TCTTCCTGTT CCTCTTTGCG 2640
GTGTGGATGG TGGCCTTTGG CGTGGCCAGG CAAGGGATCC TTAGGCAGAA TGAGCAGCGC 2700
TGGAGGTGGA TATTCCGTTC GGTCATCTAC GAGCCCTACC TGGCCATGTT CGGCCAGGTG 2760
CCCAGTGACG TGGATGGTAC CACGTATGAC TTTGCCCACT GCACCTTCAC TGGGAATGAG 2820
TCCAAGCCAC TGTGTGTGGA GCTGGATGAG CACAACCTGC CCCGGTTCCC CGAGTGGATC 2880
ACCATCCCCC TGGTGTGCAT CTACATGTTA TCCACCAACA TCCTGCTGGT CAACCTGCTG 2940
GTCGCCATGT TTGGCTACAC GGTGGGCACC GTCCAGGAGA ACAATGACCA GGTCTGGAAG 3000
TTCCAGAGGT ACTTCCTGGT GCAGGAGTAC TGCAGCCGCC TCAATATCCC CTTCCCCTTC 3060
ATCGTCTTCG CTTACTTCTA CATGGTGGTG AAGAAGTGCT TCAAGTGTTG CTGCAAGGAG 3120
AAAAACATGG AGTCTTCTGT CTGCTGTTTC AAAAATGAAG ACAATGAGAC TCTGGCATGG 3180
GAGGGTGTCA TGAAGGAAAA CTACCTTGTC AAGATCAACA CAAAAGCCAA CGACACCTCA 3240
GAGGAAATGA GGCATCGATT TAGACAACTG GATACAAAGC TTAATGATCT CAAGGGTCTT 3300
CTGAAAGAGA TTGCTAATAA AATCAAATAA AACTGTATGA AACTCTAATG GAGAAAAATC 3360
TAATTATAGC AAGATCATAT TAAGGAATGC TGATGAACAA TTTTGCTATC GACTACTAAA 3420
TGAGAGATTT TCAGACCCCT GGGTACATGG TGGATGATTT TAAATCACCC TAGTGTGCTG 3480
AGACCTTGAG AATAAAGTGT GTGATTGGTT TCATACTTGA AGACGGATAT AAAGGAAGAA 3540
TATTTCCTTT ATGTGTTTCT CCAGAATGGT GCCTGTTTCT CTCTGTGTCT CAATGCCTGG 3600
GACTGGAGGT TGATAGTTTA AGTGTGTTCT TACCGCCTCC TTTTTCCTTT AATCTTATTT 3660
TTGATGAACA CATATATAGG AGAACATCTA TCCTATGAAT AAGAACCTGG TCATGCTTTA 3720
CTCCTGTATT GTTATTTTGT TCATTTCCAA TTGATTCTCT ACTTTTCCCT TTTTTGTATT 3780
ATGTGACTAA TTAGTTGGCA TATTGTTAAA AGTCTCTCAA ATTAGGCCAG ATTCTAAAAC 3840
ATGCTGCAGC AAGAGGACCC CGCTCTCTTC AGGAAAAGTG TTTTCATTTC TCAGGATGCT 3900
TCTTACCTGT CAGAGGAGGT GACAAGGCAG TCTCTTGCTC TCTTGGACTC ACCAGGCTCC 3960
TATTGAAGGA ACCACCCCCA TTCCTAAATA TGTGAAAAGT CGCCCAAAAT GCAACCTTGA 4020
AAGGCACTAC TGACTTTGTT CTTATTGGAT ACTCCTCTTA TTTATTATTT TTCCATTAAA 4080
AATAATAGCT GGCTATTATA GAAAATTTAG ACCATACAGA GATGTAGAAA GAACATAAAT 4140
TGTCCCCATT ACCTTAAGGT AATCACTGCT AACAATTTCT GGATGGTTTT TCAAGTCTAT 4200
TTTTTTTCTA TGTATGTCTC AATTCTCTTT CAAAATTTTA CAGAATGTTA TCATACTACA 4260
TATATACTTT TTATGTAAGC TTTTTCACTT AGTATTTTAT CAAATATGTT TTTATTATAT 4320
TCATAGCCTT CTTAAACATT ATATCAATAA TTGCATAATA GGCAACCTCT AGCGATTACC 4380
ATAATTTTGC TCATTGAAGG CTATCTCCAG TTGATCATTG GGATGAGCAT CTTTGTGCAT 4440
GAATCCTATT GCTGTATTTG GGAAAATTTT CCAAGGTTAG ATTCCAATAA ATATCTATTT 4500
ATTATTAAAT ATTAAAAATAT CGATTTATTA TTAAAACCAT TTATAAGGCT
```

*Fig. 12A (2)*

```
                                                            TTTTCATAAA 4560
TGTATAGCAA ATAGGAATTA TTAACTTGAG CATAAGATAT GAGATACATG AACCTGAACT 4620
ATTAAAATAA AATATTATAT TTAACCCTAG TTTAAGAAGA AGTCAATATG CTTATTTAAA 4680
TATTATGGAT GGTGGGCAGA TCACTTGAGG TCAGGAGTTC GAGACCAGCC TGGCCAACAT 4740
GGCAAAACCA CATCTCTACT AAAAATAAAA AAATTAGCTG GGTGTGGTGG TGCACTCCTG 4800
TAATCCCAGC TACTCAGAAG GCTGAGGTAC AAGAATTGCT GGAACCTGGG AGGCGGAGGT 4860
TGCAGTGAAC CAAGATTGCA CCACTGCACT CCAGCCGGGG TGACAGAGTG AGACTCCGAC 4920
TGAAAATAAA TAAATAAATA AATAAATAAA TAAATAAATA AATATTATGG ATGGTGAAGG 4980
GAATGGTATA GAATTGGAGA GATTATCTTA CTGAACACCT GTAGTCCCAG CTTTCTCTGG 5040
AAGTGGTGGT ATTTGAGCAG GATGTGCACA AGGCAATTGA AATGCCCATA ATTAGTTTCT 5100
CAGCTTTGAA TACACTATAA ACTCAGTGGC TGAAGGAGGA AATTTTAGAA GGAAGCTACT 5160
AAAAGATCTA ATTTGAAAAA CTACAAAAGC ATTAACTAAA AAGTTTATT TTCCTTTTGT 5220
CTGGGCAGTA GTGAAAATAA CTACTCACAA CATTCACTAT GTTTGCAAGG AATTAACACA 5280
AATAAAAGAT GCCTTTTTAC TTAAACGCCA AGACAGAAAA CTTGCCCAAT ACTGAGAAGC 5340
AACTTGCATT AGAGAGGGAA CTGTTAAATG TTTTCAACCC AGTTCATCTG GTGGATGTTT 5400
TTGCAGGTTA CTCTGAGAAT TTTGCTTATG AAAAATCATT ATTTTTAGTG TAGTTCACAA 5460
TAATGTATTG AACATACTTC TAATCAAAGG TGCTATGTCC TTGTGTATGG TACTAAATGT 5520
GTCCTGTGTA CTTTTGCACA ACTGAGAATC CTGCGGCTTG GTTTAATGAG TGTGTTCATG 5580
AAATAAATAA TGGAGGAATT GTCAAAAAAA AAAAAAAAAA AAAAAAAAAA AAAAAAAAAA 5640
AAAAAAAAAA AAAAAAAAAA AAAAAAA                                    5668
```

Fig. 12A (3)

```
YRNRRNDTLDSTRTLYSSASRSTDLSYSESDLVNFIQANFKKRECVFFTKDSKATENVCKCGYAQSQHME
GTQINQSEKWNYKKHTKEFPTDAFGDIQFETLGKKGKYIRLSCDTDAEILYELLTQHWHLKTPNLVISVT
GGAKNFALKPRMRKIFSRLIYIAQSKGAWILTGGTHYGLTKYIGEVVRDNTISRSSEENIVAIGIAAWGM
VSNRDTLIRNCDAEGYFLAQYLMDDFTRDPLYILDNNHTHLLLVDNGCHGHPTVEAKLRNQLEKHISERT
IQDSNYGGKIPIVCFAQGGGKETLKAINTSIKNKIPCVVVEGSGRIADVIASLVEVEDAPTSSAVKEKLV
RFLPRTVSRLSEEETESWIKWLKEILECSHLLTVIKMEEAGDEIVSNAISYALYKAFSTSEQDKDNWNGQ
LKLLLEWNQLDLANDEIFTNDRRWESADLQEVMFTALIKDRPKFVRLFLENGLNLRKFLTHDVLTELFSN
HFSTLVYRNLQIAKNSYNDALLTFVWKLVANFRRGFRKEDRNGRDEMDIELHDVSPITRHPLQALFIWAI
LQNKKELSKVIWEQTRGCTLAALGASKLLKTLAKVKNDINAAGESEELANEYETRAVELFTECYSSDEDL
AEQLLVYSCEAWGGSNCLELAVEATDQHFTAQPGVQNFLSKQWYGEISRDTKNWKIILCLFIIPLVGCGF
VSFRKKPVDKHKKLLWYYVAFFTSPFVVFSWNVVFYIAFLLLFAYVLLMDFHSVPHPPELVLYSLVFVLF
CDEVRQWYVNGVNYFTDLWNVMDTLGLFYFIAGIVFRLHSSNKSSLYSGRVIFCLDYIIFTLRLIHIFTV
SRNLGPKIIMLQRMLIDVFFFLFLFAVWMVAFGVARQGILRQNEQRWRWIFRSVIYEPYLAMFGQVPSDV
DGTTYDFAHCTFTGNESKPLCVELDEHNLPRFPEWITIPLVCIYMLSTNILLVNLLVAMFGYTVGTVQEN
NDQVWKFQRYFLVQEYCSRLNIPFPFIVFAYFYMVVKKCFKCCCKEKNMESSVCCFKNEDNETLAWEGVM
KENYLVKINTKANDTSEEMRHRFRQLDTKLNDLKGLLKEIANKIK
```

Fig. 12B

COMPOSITIONS AND METHODS FOR THE THERAPY AND DIAGNOSIS OF PROSTATE CANCER

CROSS REFERENCE TO RELATED APPLICATIONS

This application is related to U.S. patent application Ser. No. 09/657,279, filed Sep. 6, 2000; U.S. application Ser. No. 09/651,236, filed Aug. 29, 2000; U.S. application Ser. No.09/636,215, filed Aug. 9, 2000; U.S. application Ser. No. 09/605,783, filed Jun. 27, 2000; U.S. application Ser. No. 09/593,793, filed Jun. 13, 2000; U.S. application Ser. No. 09/570,737, filed May 12, 2000; U.S. application Ser. No. 09/568,100, filed May 9, 2000; U.S. application Ser. No. 09/536,857, filed Mar. 27, 2000; U.S. application Ser. No. 09/483,672, filed Jan. 14, 2000; U.S. application Ser. No. 09/443,686, filed Nov.18, 1999; U.S. application Ser. No. 09/439,313, filed Nov. 12, 1999; U.S. application Ser. No. 09/352,616, filed Jul. 13, 1999; U.S. application Ser. No. 09/288,946, filed Apr. 9, 1999; U.S. application Ser. No. 09/232,149, filed Jan. 15, 1999; U.S. application Ser. No. 09/159,812, filed Sep. 23, 1998; U.S. application Ser. No. 09/115,453, filed Jul. 14, 1998; U.S. application Ser. No. 09/030,607, filed Feb. 25, 1998; U.S. application Ser. No. 09/020,956, filed Feb. 9, 1998; U.S. application Ser. No. 08/904,804, filed Aug. 1, 1997 (abandoned); U.S. application Ser. No. 08/806,099, filed Feb. 25, 1997 (abandoned); each a CIP of the previously filed application and pending unless noted; and PCT/US98/03492, filed Feb. 25, 1998 (converted) and PCT/US99/15838, filed Jul. 14, 1999, pending.

TECHNICAL FIELD OF THE INVENTION

The present invention relates generally to therapy and diagnosis of cancer, such as prostate cancer. The invention is more specifically related to polypeptides, comprising at least a portion of a prostate-specific protein, and to polynucleotides encoding such polypeptides. Such polypeptides and polynucleotides are useful in pharmaceutical compositions, e.g., vaccines, and other compositions for the diagnosis and treatment of prostate cancer.

BACKGROUND OF THE INVENTION

Cancer is a significant health problem throughout the world. Although Cancer is a significant health problem throughout the world. Although advances have been made in detection and therapy of cancer, no vaccine or other universally successful method for prevention or treatment is currently available. Current therapies, which are generally based on a combination of chemotherapy or surgery and radiation, continue to prove inadequate in many patients.

Prostate cancer is the most common form of cancer among males, with an estimated incidence of 30% in men over the age of 50. Overwhelming clinical evidence shows that human prostate cancer has the propensity to metastasize to bone, and the disease appears to progress inevitably from androgen dependent to androgen refractory status, leading to increased patient mortality. This prevalent disease is currently the second leading cause of cancer death among men in the U.S.

In spite of considerable research into therapies for the disease, prostate cancer remains difficult to treat. Commonly, treatment is based on surgery and/or radiation therapy, but these methods are ineffective in a significant percentage of cases. Two previously identified prostate specific proteins—prostate specific antigen (PSA) and prostatic acid phosphatase (PAP)—have limited therapeutic and diagnostic potential. For example, PSA levels do not always correlate well with the presence of prostate cancer, being positive in a percentage of non-prostate cancer cases, including benign prostatic hyperplasia (BPH). Furthermore, PSA measurements correlate with prostate volume, and do not indicate the level of metastasis.

In spite of considerable research into therapies for these and other cancers, prostate cancer remains difficult to diagnose and treat effectively. Accordingly, there is a need in the art for improved methods for detecting and treating such cancers. The present invention fulfills these needs and further provides other related advantages.

SUMMARY OF THE INVENTION

In one aspect, the present invention provides polynucleotide compositions comprising a sequence selected from the group consisting of:

(a) sequences provided in SEQ ID NO: 1–111, 115–171, 173–175, 177, 179–305, 307–315, 326, 328, 330, 332–335, 340–375, 381, 382 and 384–476, 524, 526, 530, 531, 533, 535, 536, 552, 569–572, 587, 591, 593–606, 618–705, 709–774, 777, 789, 817, 823, 824, 878, 880–882 and 894;

(b) complements of the sequences provided in SEQ ID NO: 1–111, 115–171, 173–175, 177, 179–305, 307–315, 326, 328, 330, 332–335, 340–375, 381, 382 and 384–476, 524, 526, 530, 531, 533, 535, 536, 552, 569–572, 587, 591, 593–606, 618–705, 709–774, 777, 789, 817, 823, 824, 878, 880–882 and 894;

(c) sequences consisting of at least 20 contiguous residues of a sequence provided in SEQ ID NO: 1–111, 115–171, 173–175, 177, 179–305, 307–315, 326, 328, 330, 332–335, 340–375, 381, 382 and 384–476, 524, 526, 530, 531, 533, 535, 536, 552, 569–572, 587, 591, 593–606, 618–705, 709–774, 777, 789, 817, 823, 824, 878, 880–882 and 894;

(d) sequences that hybridize to a sequence provided in SEQ ID NO: 1–111, 115–171, 173–175, 177, 179–305, 307–315, 326, 328, 330, 332–335, 340–375, 381, 382 and 384–476, 524, 526, 530, 531, 533, 535, 536, 552, 569–572, 587, 591, 593–606, 618–705, 709–774, 777, 789, 817, 823, 824, 878, 880–882 and 894, under moderately stringent conditions;

(e) sequences having at least 75% identity to a sequence of SEQ ID NO: 1–111, 115–171, 173–175, 177, 179–305, 307–315, 326, 328, 330, 332–335, 340–375, 381, 382 and 384–476, 524, 526, 530, 531, 533, 535, 536, 552, 569–572, 587, 591, 593–606, 618–705, 709–774, 777, 789, 817, 823, 824, 878, 880–882 and 894;

(f) sequences having at least 90% identity to a sequence of SEQ ID NO: 1–111, 115–171, 173–175, 177, 179–305, 307–315, 326, 328, 330, 332–335, 340–375, 381, 382 and 384–476, 524, 526, 530, 531, 533, 535, 536, 552, 569–572, 587, 591, 593–606, 618–705, 709–774, 777, 789, 817, 823, 824, 878, 880–882 and 894; and (g) degenerate variants of a sequence provided in SEQ ID NO: 1–111, 115–171, 173–175, 177, 179–305, 307–315, 326, 328, 330, 332–335, 340–375, 381, 382 and 384–476, 524, 526, 530, 531, 533, 535, 536, 552, 569–572, 587, 591, 593–606, 618–705, 709–774, 777, 789, 817, 823, 824, 878, 880–882 and 894.

In one preferred embodiment, the polynucleotide compositions of the invention are expressed in at least about 20%, more preferably in at least about 30%, and most preferably in at least about 50% of prostate tissue samples tested, at a level that is at least about 2-fold, preferably at least about 5-fold, and most preferably at least about 10-fold higher than that for normal tissues.

The present invention, in another aspect, provides polypeptide compositions comprising an amino acid sequence that is encoded by a polynucleotide sequence described above.

The present invention further provides polypeptide compositions comprising an amino acid sequence selected from the group consisting of sequences recited in SEQ ID NO: 112–114, 172, 176, 178, 327, 329, 331, 336, 339, 376–380, 383, 477–483, 496, 504, 505, 519, 520, 522, 525, 527, 532, 534, 537–551, 553–568, 573–586, 588–590, 592, 706–708, 775, 776, 778, 780, 781, 811, 814, 818, 826, 827, 853, 855, 858, 860–862, 866–877, 879, 883–893 and 895.

In certain preferred embodiments, the polypeptides and/or polynucleotides of the present invention are immunogenic, i.e., they are capable of eliciting an immune response, particularly a humoral and/or cellular immune response, as further described herein.

The present invention further provides fragments, variants and/or derivatives of the disclosed polypeptide and/or polynucleotide sequences, wherein the fragments, variants and/or derivatives preferably have a level of immunogenic activity of at least about 50%, preferably at least about 70% and more preferably at least about 90% of the level of immunogenic activity of a polypeptide sequence set forth in SEQ ID NO: 112–114, 172, 176, 178, 327, 329, 331, 336, 339, 376–380, 383, 477–483, 496, 504, 505, 519, 520, 522, 525, 527, 532, 534, 537–551, 553–568, 573–586, 588–590, 592, 706–708, 775, 776, 778, 780, 781, 811, 814, 818, 826, 827, 853, 855, 858 or 860–862, or a polypeptide sequence encoded by a polynucleotide sequence set forth in SEQ ID NO: 1–111, 115–171, 173–175, 177, 179–305, 307–315, 326, 328, 330, 332–335, 340–375, 381, 382 and 384–476, 524, 526, 530, 531, 533, 535, 536, 552, 569–572, 587, 591, 593–606, 618–705, 709–774, 777, 789, 817, 823, 824, 878, 880–882 and 894.

The present invention further provides polynucleotides that encode a polypeptide described above, expression vectors comprising such polynucleotides and host cells transformed or transfected with such expression vectors.

Within other aspects, the present invention provides pharmaceutical compositions comprising a polypeptide or polynucleotide as described above and a physiologically acceptable carrier.

Within a related aspect of the present invention, pharmaceutical compositions, e.g., vaccine compositions, are provided for prophylactic or therapeutic applications. Such compositions generally comprise an immunogenic polypeptide or polynucleotide of the invention and an immunostimulant, such as an adjuvant, together with a physiologically acceptable carrier.

The present invention further provides pharmaceutical compositions that comprise: (a) an antibody or antigen-binding fragment thereof that specifically binds to a polypeptide of the present invention, or a fragment thereof; and (b) a physiologically acceptable carrier.

Within further aspects, the present invention provides pharmaceutical compositions comprising: (a) an antigen presenting cell that expresses a polypeptide as described above and (b) a pharmaceutically acceptable carrier or excipient. Illustrative antigen presenting cells include dendritic cells, macrophages, monocytes, fibroblasts and B cells.

Within related aspects, pharmaceutical compositions are provided that comprise: (a) an antigen presenting cell that expresses a polypeptide as described above and (b) an immunostimulant.

The present invention further provides, in other aspects, fusion proteins that comprise at least one polypeptide as described above, as well as polynucleotides encoding such fusion proteins, typically in the form of pharmaceutical compositions, e.g., vaccine compositions, comprising a physiologically acceptable carrier and/or an immunostimulant. The fusions proteins may comprise multiple immunogenic polypeptides or portions/variants thereof, as described herein, and may further comprise one or more polypeptide segments for facilitating and/or enhancing the expression, purification and/or immunogenicity of the polypeptide(s).

Within further aspects, the present invention provides methods for stimulating an immune response in a patient, preferably a T cell response in a human patient, comprising administering a pharmaceutical composition described herein. The patient may be afflicted with prostate cancer, in which case the methods provide treatment for the disease, or a patient considered to be at risk for such a disease may be treated prophylactically.

Within further aspects, the present invention provides methods for inhibiting the development of a cancer in a patient, comprising administering to a patient a pharmaceutical composition as recited above. The patient may be afflicted with prostate cancer, in which case the methods provide treatment for the disease, or a patient considered to be at risk for such a disease may be treated prophylactically.

The present invention further provides, within other aspects, methods for removing tumor cells from a biological sample, comprising contacting a biological sample with T cells that specifically react with a polypeptide of the present invention, wherein the step of contacting is performed under conditions and for a time sufficient to permit the removal of cells expressing the polypeptide from the sample.

Within related aspects, methods are provided for inhibiting the development of a cancer in a patient, comprising administering to a patient a biological sample treated as described above.

Methods are further provided, within other aspects, for stimulating and/or expanding T cells specific for a polypeptide of the present invention, comprising contacting T cells with one or more of: (i) a polypeptide as described above; (ii) a polynucleotide encoding such a polypeptide; and (iii) an antigen presenting cell that expresses such a polypeptide; under conditions and for a time sufficient to permit the stimulation and/or expansion of T cells. Isolated T cell populations comprising T cells prepared as described above are also provided.

Within further aspects, the present invention provides methods for inhibiting the development of a cancer in a patient, comprising administering to a patient an effective amount of a T cell population as described above.

The present invention further provides methods for inhibiting the development of a cancer in a patient, comprising the steps of: (a) incubating $CD4^+$ and/or $CD8^+$ T cells isolated from a patient with one or more of: (i) a polypeptide comprising at least an immunogenic portion of polypeptide disclosed herein; (ii) a polynucleotide encoding such a polypeptide; and (iii) an antigen-presenting cell that expressed such a polypeptide; and (b) administering to the patient an effective amount of the proliferated T cells, thereby inhibiting the development of a cancer in the patient. Proliferated cells may, but need not, be cloned prior to administration to the patient.

Within further aspects, the present invention provides methods for determining the presence or absence of a cancer, preferably a prostate cancer, in a patient comprising: (a) contacting a biological sample obtained from a patient with a binding agent that binds to a polypeptide as recited above; (b) detecting in the sample an amount of polypeptide that binds to the binding agent; and (c) comparing the amount of polypeptide with a predetermined cut-off value, and therefrom determining the presence or absence of a cancer in the patient. Within preferred embodiments, the binding agent is an antibody, more preferably a monoclonal antibody.

The present invention also provides, within other aspects, methods for monitoring the progression of a cancer in a patient. Such methods comprise the steps of: (a) contacting a biological sample obtained from a patient at a first point in time with a binding agent that binds to a polypeptide as recited above; (b) detecting in the sample an amount of polypeptide that binds to the binding agent; (c) repeating steps (a) and (b) using a biological sample obtained from the patient at a subsequent point in time; and (d) comparing the amount of polypeptide detected in step (c) with the amount detected in step (b), and therefrom monitoring the progression of the cancer in the patient.

The present invention further provides, within other aspects, methods for determining the presence or absence of a cancer in a patient, comprising the steps of: (a) contacting a biological sample obtained from a patient with an oligonucleotide that hybridizes to a polynucleotide of the present invention; (b) detecting in the sample a level of a polynucleotide, preferably mRNA, that hybridizes to the oligonucleotide; and (c) comparing the level of polynucleotide that hybridizes to the oligonucleotide with a predetermined cut-off value, and therefrom determining the presence or absence of a cancer in the patient. Within certain embodiments, the amount of mRNA is detected via polymerase chain reaction using, for example, at least one oligonucleotide primer that hybridizes to a polynucleotide of the present invention, or a complement of such a polynucleotide. Within other embodiments, the amount of mRNA is detected using a hybridization technique, employing an oligonucleotide probe that hybridizes to an inventive polynucleotide, or a complement of such a polynucleotide.

In related aspects, methods are provided for monitoring the progression of a cancer in a patient, comprising the steps of: (a) contacting a biological sample obtained from a patient with an oligonucleotide that hybridizes to a polynucleotide of the present invention; (b) detecting in the sample an amount of a polynucleotide that hybridizes to the oligonucleotide; (c) repeating steps (a) and (b) using a biological sample obtained from the patient at a subsequent point in time; and (d) comparing the amount of polynucleotide detected in step (c) with the amount detected in step (b), and therefrom monitoring the progression of the cancer in the patient.

Within further aspects, the present invention provides antibodies, such as monoclonal antibodies, that bind to a polypeptide as described above, as well as diagnostic kits comprising such antibodies. Diagnostic kits comprising one or more oligonucleotide probes or primers as described above are also provided.

These and other aspects of the present invention will become apparent upon reference to the following detailed description and attached drawings. All references disclosed herein are hereby incorporated by reference in their entirety as if each was incorporated individually.

BRIEF DESCRIPTION OF THE DRAWINGS AND SEQUENCE IDENTIFIERS

FIG. 1 illustrates the ability of T cells to kill fibroblasts expressing the representative prostate-specific polypeptide P502S, as compared to control fibroblasts. The percentage lysis is shown as a series of effector:target ratios, as indicated.

FIGS. 2A and 2B illustrate the ability of T cells to recognize cells expressing the representative prostate-specific polypeptide P502S. In each case, the number of γ-interferon spots is shown for different numbers of responders. In FIG. 2A, data is presented for fibroblasts pulsed with the P2S-12 peptide, as compared to fibroblasts pulsed with a control E75 peptide. In FIG. 2B, data is presented for fibroblasts expressing P502S, as compared to fibroblasts expressing HER-2/neu.

FIG. 3 represents a peptide competition binding assay showing that the P1S#10 peptide, derived from P501S, binds HLA-A2. Peptide P1S#10 inhibits HLA-A2 restricted presentation of fluM58 peptide to CTL clone D150M58 in TNF release bioassay. D150M58 CTL is specific for the HLA-A2 binding influenza matrix peptide fluM58.

Figure 6A:
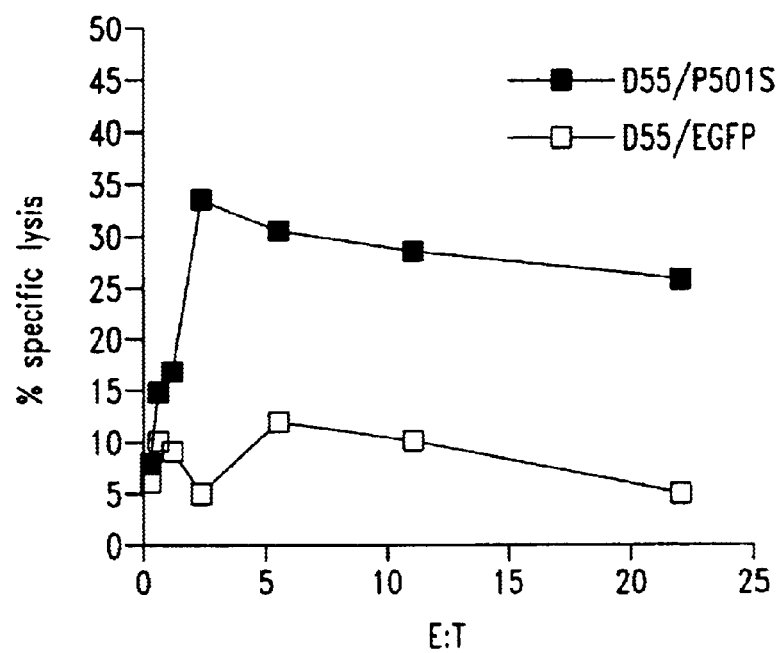
Figure 6B:
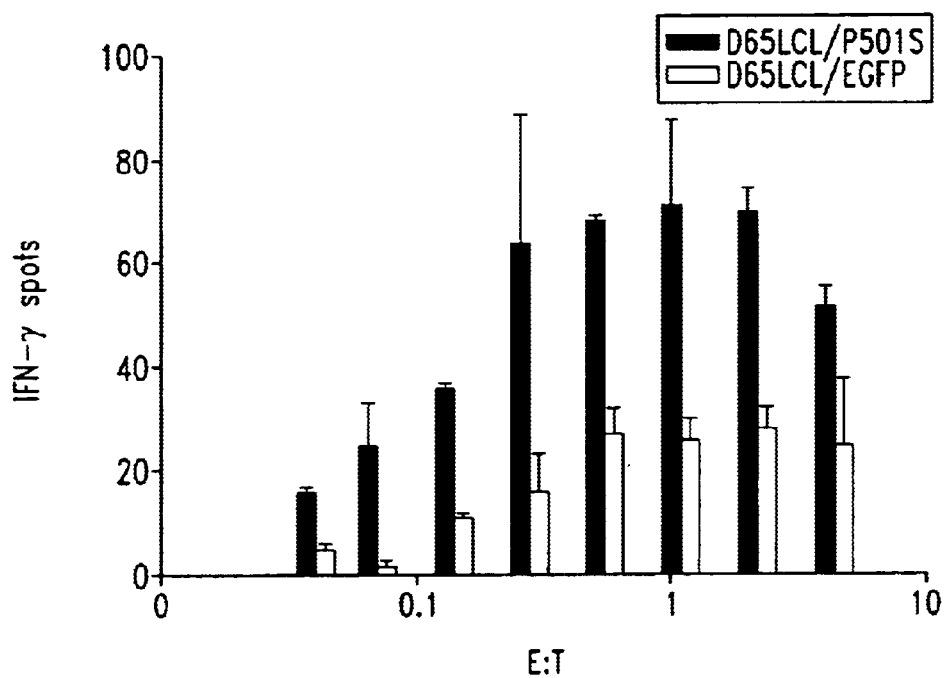

FIGS. 6A and 6B are graphs illustrating the specificity of a CD8$^+$ cell line (3A-1) for a representative prostate-specific antigen (P501S). FIG. 6A shows the results of a $^{51}$Cr release assay. The percent specific lysis is shown as a series of effector:target ratios, as indicated. FIG. 6B shows the production of interferon-gamma by 3A-1 cells stimulated with autologous B-LCL transduced with P501S, at varying effector:target rations as indicated.

Figure 7:
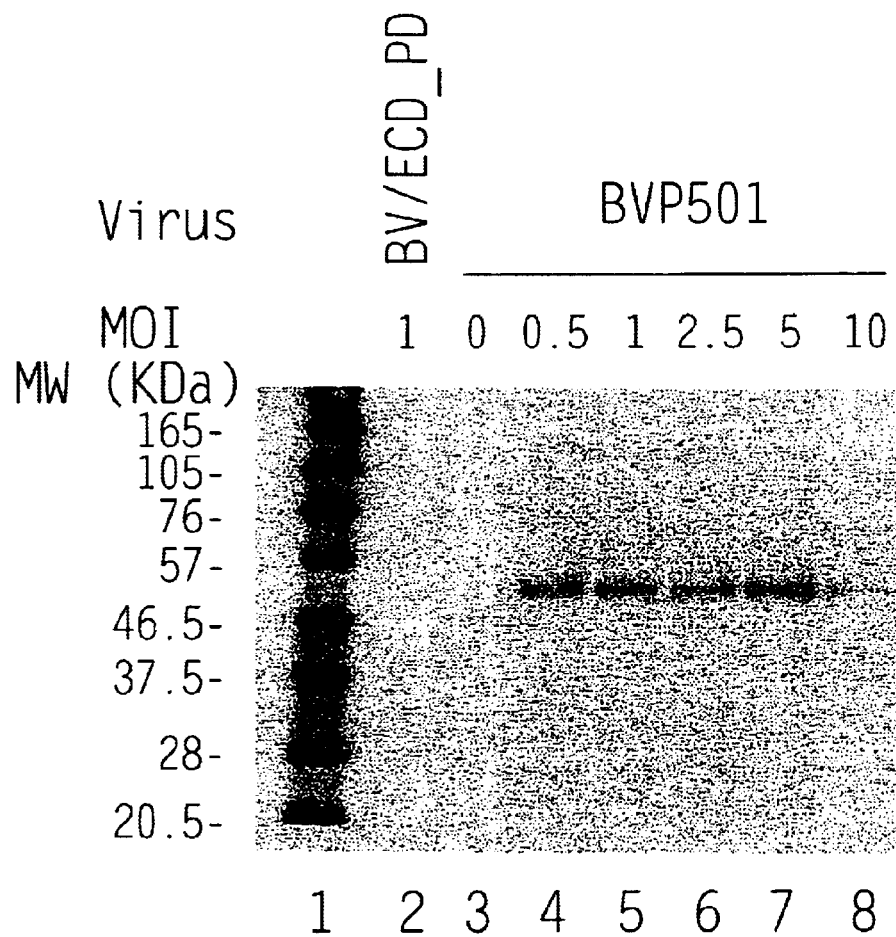

FIG. 7 is a Western blot showing the expression of P501S in baculovirus.

FIG. 8 illustrates the results of epitope mapping studies on P501S.

FIG. 9 is a schematic representation of the P501S protein showing the location of transmembrane domains and predicted intracellular and extracellular domains.

Figure 10:
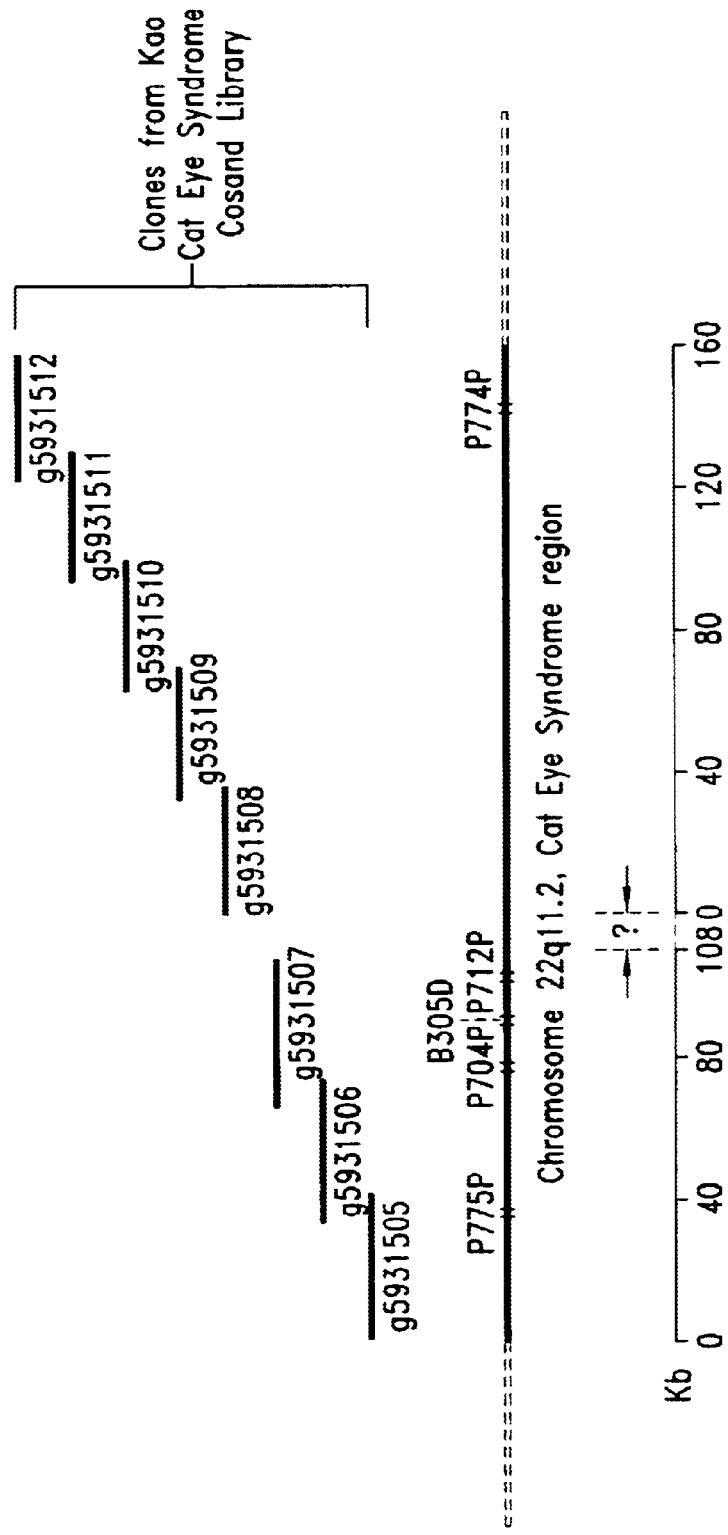

FIG. 10 is a genomic map showing the location of the prostate genes P775P, P704P, B305D, P712P and P774P within the Cat Eye Syndrome region of chromosome 22q11.2

Figure 11:
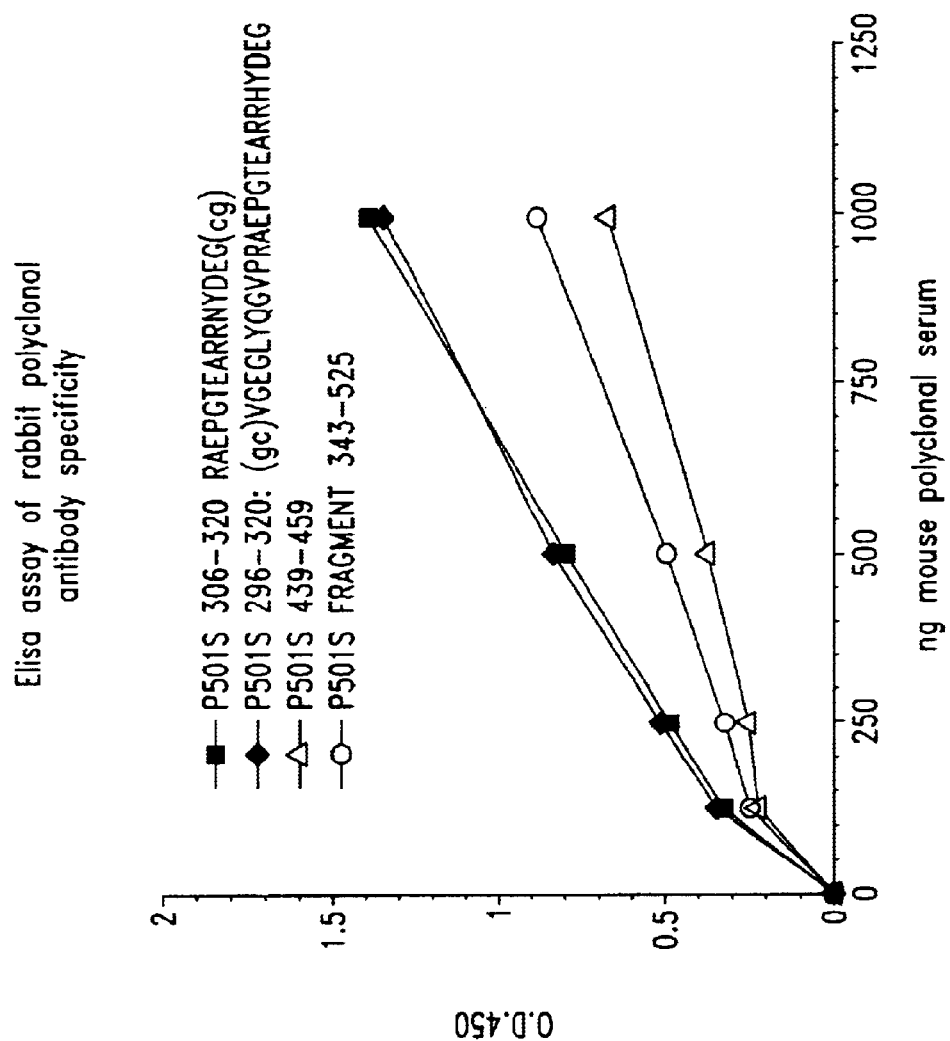

FIG. 11 shows the results of an ELISA assay to determine the specificity of rabbit polyclonal antisera raised against P501S.

FIGS. 12A(1), 12A(2), 12A(3), and B are the full-length cDNA (SEQ ID NO:591) and predicted amino acid (SEQ ID NO:592) sequences, respectively, for the clone P788P.

SEQ ID NO: 1 is the determined cDNA sequence for F1-13

SEQ ID NO: 2 is the determined 3' cDNA sequence for F1-12

SEQ ID NO: 3 is the determined 5' cDNA sequence for F1-12

SEQ ID NO: 4 is the determined 3' cDNA sequence for F1-16

SEQ ID NO: 5 is the determined 3' cDNA sequence for H1-1

SEQ ID NO: 6 is the determined 3' cDNA sequence for H1-9

SEQ ID NO: 7 is the determined 3' cDNA sequence for H1-4

SEQ ID NO: 8 is the determined 3' cDNA sequence for J1-17

SEQ ID NO: 9 is the determined 5' cDNA sequence for J1-17

SEQ ID NO: 10 is the determined 3' cDNA sequence for L1-12

SEQ ID NO: 10 is the determined 5' cDNA sequence for L1-12

SEQ ID NO: 12 is the determined 3' cDNA sequence for N1-1862

SEQ ID NO: 13 is the determined 5' cDNA sequence for N1-1862

SEQ ID NO: 14 is the determined 3' cDNA sequence for J1-13

SEQ ID NO: 15 is the determined 5' cDNA sequence for J1–13

SEQ ID NO: 16 is the determined 3' cDNA sequence for J1-19

SEQ ID NO: 17 is the determined 5' cDNA sequence for J1-19

SEQ ID NO: 18 is the determined 3' cDNA sequence for J1-25

SEQ ID NO: 19 is the determined 5' cDNA sequence for J1-25

SEQ ID NO: 20 is the determined 5' cDNA sequence for J1-24

SEQ ID NO: 21 is the determined 3' cDNA sequence for J1-24

SEQ ID NO: 22 is the determined 5' cDNA sequence for K1-58

SEQ ID NO: 23 is the determined 3' cDNA sequence for K1-58

SEQ ID NO: 24 is the determined 5' cDNA sequence for K1-63

SEQ ID NO: 25 is the determined 3' cDNA sequence for K1-63

SEQ ID NO: 26 is the determined 5' cDNA sequence for L1-4

SEQ ID NO: 27 is the determined 3' cDNA sequence for L1-4

SEQ ID NO: 28 is the determined 5' cDNA sequence for L1-14

SEQ ID NO: 29 is the determined 3' cDNA sequence for L1-14

SEQ ID NO: 30 is the determined 3' cDNA sequence for J1-12

SEQ ID NO: 31 is the determined 3' cDNA sequence for J1-16

SEQ ID NO: 32 is the determined 3' cDNA sequence for J1-21

SEQ ID NO: 33 is the determined 3' cDNA sequence for K1-48

SEQ ID NO: 34 is the determined 3' cDNA sequence for K1-55

SEQ ID NO: 35 is the determined 3' cDNA sequence for L1-2

SEQ ID NO: 36 is the determined 3' cDNA sequence for L1-6

SEQ ID NO: 37 is the determined 3' cDNA sequence for N1-1858

SEQ ID NO: 38 is the determined 3' cDNA sequence for N1-1860

SEQ ID NO: 39 is the determined 3' cDNA sequence for N1-1861

SEQ ID NO: 40 is the determined 3' cDNA sequence for N1-1864

SEQ ID NO: 41 is the determined cDNA sequence for P5

SEQ ID NO: 42 is the determined cDNA sequence for P8

SEQ ID NO: 43 is the determined cDNA sequence for P9

SEQ ID NO: 44 is the determined cDNA sequence for P18

SEQ ID NO: 45 is the determined cDNA sequence for P20

SEQ ID NO: 46 is the determined cDNA sequence for P29

SEQ ID NO: 47 is the determined cDNA sequence for P30

SEQ ID NO: 48 is the determined cDNA sequence for P34

SEQ ID NO: 49 is the determined cDNA sequence for P36

SEQ ID NO: 50 is the determined cDNA sequence for P38

SEQ ID NO: 51 is the determined cDNA sequence for P39

SEQ ID NO: 52 is the determined cDNA sequence for P42

SEQ ID NO: 53 is the determined cDNA sequence for P47

SEQ ID NO: 54 is the determined cDNA sequence for P49

SEQ ID NO: 55 is the determined cDNA sequence for P50

SEQ ID NO: 56 is the determined cDNA sequence for P53

SEQ ID NO: 57 is the determined cDNA sequence for P55

SEQ ID NO: 58 is the determined cDNA sequence for P60

SEQ ID NO: 59 is the determined cDNA sequence for P64

SEQ ID NO: 60 is the determined cDNA sequence for P65

SEQ ID NO: 61 is the determined cDNA sequence for P73

SEQ ID NO: 62 is the determined cDNA sequence for P75

SEQ ID NO: 63 is the determined cDNA sequence for P76

SEQ ID NO: 64 is the determined cDNA sequence for P79

SEQ ID NO: 65 is the determined cDNA sequence for P84

SEQ ID NO: 66 is the determined cDNA sequence for P68

SEQ ID NO: 67 is the determined cDNA sequence for P80 (also referred to as P704P)

SEQ ID NO: 68 is the determined cDNA sequence for P82

SEQ ID NO: 69 is the determined cDNA sequence for U1-3064

SEQ ID NO: 70 is the determined cDNA sequence for U1-3065

SEQ ID NO: 71 is the determined cDNA sequence for V1-3692

SEQ ID NO: 72 is the determined cDNA sequence for 1A-3905

SEQ ID NO: 73 is the determined cDNA sequence for V1-3686

SEQ ID NO: 74 is the determined cDNA sequence for R1-2330

SEQ ID NO: 75 is the determined cDNA sequence for 1B-3976

SEQ ID NO: 76 is the determined cDNA sequence for V1-3679

SEQ ID NO: 77 is the determined cDNA sequence for 1G-4736

SEQ ID NO: 78 is the determined cDNA sequence for 1G-4738

SEQ ID NO: 79 is the determined cDNA sequence for 1G-4741

SEQ ID NO: 80 is the determined cDNA sequence for 1G-4744

SEQ ID NO: 81 is the determined cDNA sequence for 1G-4734

SEQ ID NO: 82 is the determined cDNA sequence for 1H-4774

SEQ ID NO: 83 is the determined cDNA sequence for 1H-4781

SEQ ID NO: 84 is the determined cDNA sequence for 1H-4785

SEQ ID NO: 85 is the determined cDNA sequence for 1H-4787

SEQ ID NO: 86 is the determined cDNA sequence for 1H-4796

SEQ ID NO: 87 is the determined cDNA sequence for 1I-4807

SEQ ID NO: 88 is the determined cDNA sequence for 1I-4810

SEQ ID NO: 89 is the determined cDNA sequence for 1I-4811

SEQ ID NO: 90 is the determined cDNA sequence for 1J-4876

SEQ ID NO: 91 is the determined cDNA sequence for 1K-4884

SEQ ID NO: 92 is the determined cDNA sequence for 1K-4896

SEQ ID NO: 93 is the determined cDNA sequence for 1G-4761

SEQ ID NO: 94 is the determined cDNA sequence for 1G-4762

SEQ ID NO: 95 is the determined cDNA sequence for 1H-4766

SEQ ID NO: 96 is the determined cDNA sequence for 1H-4770

SEQ ID NO: 97 is the determined cDNA sequence for 1H-4771

SEQ ID NO: 98 is the determined cDNA sequence for 1H-4772

SEQ ID NO: 99 is the determined cDNA sequence for 1D-4297

SEQ ID NO: 100 is the determined cDNA sequence for 1D-4309

SEQ ID NO: 101 is the determined cDNA sequence for 1D-1-4278

SEQ ID NO: 102 is the determined cDNA sequence for 1D-4288

SEQ ID NO: 103 is the determined cDNA sequence for 1D-4283

SEQ ID NO: 104 is the determined cDNA sequence for 1D-4304

SEQ ID NO: 105 is the determined cDNA sequence for 1D-4296

SEQ ID NO: 106 is the determined cDNA sequence for 1D-4280

SEQ ID NO: 107 is the determined full length cDNA sequence for F1-12 (also referred to as P504S)

SEQ ID NO: 108 is the predicted amino acid sequence for F1-12

SEQ ID NO: 109 is the determined full length cDNA sequence for J1-17

SEQ ID NO: 110 is the determined full length cDNA sequence for L1-12 (also referred to as P501S)

SEQ ID NO: 111 is the determined full length cDNA sequence for N-1-1862 (also referred to as P503S)

SEQ ID NO: 112 is the predicted amino acid sequence for J1-17

SEQ ID NO: 113 is the predicted amino acid sequence for L1-12 (also referred to as P501S)

SEQ ID NO: 114 is the predicted amino acid sequence for N1-1862 (also referred to as P503S)

SEQ ID NO: 115 is the determined cDNA sequence for P89

SEQ ID NO: 116 is the determined cDNA sequence for P90

SEQ ID NO: 117 is the determined cDNA sequence for P92

SEQ ID NO: 118 is the determined cDNA sequence for P95

SEQ ID NO: 119 is the determined cDNA sequence for P98

SEQ ID NO: 120 is the determined cDNA sequence for P102

SEQ ID NO: 121 is the determined cDNA sequence for P110

SEQ ID NO: 122 is the determined cDNA sequence for P111

SEQ ID NO: 123 is the determined cDNA sequence for P114

SEQ ID NO: 124 is the determined cDNA sequence for P115

SEQ ID NO: 125 is the determined cDNA sequence for P116

SEQ ID NO: 126 is the determined cDNA sequence for P124

SEQ ID NO: 127 is the determined cDNA sequence for P126

SEQ ID NO: 128 is the determined cDNA sequence for P130

SEQ ID NO: 129 is the determined cDNA sequence for P133

SEQ ID NO: 130 is the determined cDNA sequence for P138

SEQ ID NO: 131 is the determined cDNA sequence for P143

SEQ ID NO: 132 is the determined cDNA sequence for P151

SEQ ID NO: 133 is the determined cDNA sequence for P156

SEQ ID NO: 134 is the determined cDNA sequence for P157

SEQ ID NO: 135 is the determined cDNA sequence for P166

SEQ ID NO: 136 is the determined cDNA sequence for P176

SEQ ID NO: 137 is the determined cDNA sequence for P178

SEQ ID NO: 138 is the determined cDNA sequence for P179

SEQ ID NO: 139 is the determined cDNA sequence for P185

SEQ ID NO: 140 is the determined cDNA sequence for P192

SEQ ID NO: 141 is the determined cDNA sequence for P201

SEQ ID NO: 142 is the determined cDNA sequence for P204
SEQ ID NO: 143 is the determined cDNA sequence for P208
SEQ ID NO: 144 is the determined cDNA sequence for P211
SEQ ID NO: 145 is the determined cDNA sequence for P213
SEQ ID NO: 146 is the determined cDNA sequence for P219
SEQ ID NO: 147 is the determined cDNA sequence for P237
SEQ ID NO: 148 is the determined cDNA sequence for P239
SEQ ID NO: 149 is the determined cDNA sequence for P248
SEQ ID NO: 150 is the determined cDNA sequence for P251
SEQ ID NO: 151 is the determined cDNA sequence for P255
SEQ ID NO: 152 is the determined cDNA sequence for P256
SEQ ID NO: 153 is the determined cDNA sequence for P259
SEQ ID NO: 154 is the determined cDNA sequence for P260
SEQ ID NO: 155 is the determined cDNA sequence for P263
SEQ ID NO: 156 is the determined cDNA sequence for P264
SEQ ID NO: 157 is the determined cDNA sequence for P266
SEQ ID NO: 158 is the determined cDNA sequence for P270
SEQ ID NO: 159 is the determined cDNA sequence for P272
SEQ ID NO: 160 is the determined cDNA sequence for P278
SEQ ID NO: 161 is the determined cDNA sequence for P105
SEQ ID NO: 162 is the determined cDNA sequence for P107
SEQ ID NO: 163 is the determined cDNA sequence for P137
SEQ ID NO: 164 is the determined cDNA sequence for P194
SEQ ID NO: 165 is the determined cDNA sequence for P195
SEQ ID NO: 166 is the determined cDNA sequence for P196
SEQ ID NO: 167 is the determined cDNA sequence for P220
SEQ ID NO: 168 is the determined cDNA sequence for P234
SEQ ID NO: 169 is the determined cDNA sequence for P235
SEQ ID NO: 170 is the determined cDNA sequence for P243
SEQ ID NO: 171 is the determined cDNA sequence for P703P-DE1
SEQ ID NO: 172 is the predicted amino acid sequence for P703P-DE1
SEQ ID NO: 173 is the determined cDNA sequence for P703P-DE2
SEQ ID NO: 174 is the determined cDNA sequence for P703P-DE6
SEQ ID NO: 175 is the determined cDNA sequence for P703P-DE13
SEQ ID NO: 176 is the predicted amino acid sequence for P703P-DE13
SEQ ID NO: 177 is the determined cDNA sequence for P703P-DE14
SEQ ID NO: 178 is the predicted amino acid sequence for P703P-DE14
SEQ ID NO: 179 is the determined extended cDNA sequence for 1G-4736
SEQ ID NO: 180 is the determined extended cDNA sequence for 1G-4738
SEQ ID NO: 181 is the determined extended cDNA sequence for 1G-4741
SEQ ID NO: 182 is the determined extended cDNA sequence for 1G-4744
SEQ ID NO: 183 is the determined extended cDNA sequence for 1H-4774
SEQ ID NO: 184 is the determined extended cDNA sequence for 1H-4781
SEQ ID NO: 185 is the determined extended cDNA sequence for 1H-4785
SEQ ID NO: 186 is the determined extended cDNA sequence for 1H-4787
SEQ ID NO: 187 is the determined extended cDNA sequence for 1H-4796
SEQ ID NO: 188 is the determined extended cDNA sequence for 1I-4807
SEQ ID NO: 189 is the determined 3' cDNA sequence for 1I-4810
SEQ ID NO: 190 is the determined 3' cDNA sequence for 1I-4811
SEQ ID NO: 191 is the determined extended cDNA sequence for 1J-4876
SEQ ID NO: 192 is the determined extended cDNA sequence for 1K-4884
SEQ ID NO: 193 is the determined extended cDNA sequence for 1K-4896
SEQ ID NO: 194 is the determined extended cDNA sequence for 1G-4761
SEQ ID NO: 195 is the determined extended cDNA sequence for 1G-4762
SEQ ID NO: 196 is the determined extended cDNA sequence for 1H-4766
SEQ ID NO: 197 is the determined 3' cDNA sequence for 1H-4770
SEQ ID NO: 198 is the determined 3' cDNA sequence for 1H-4771
SEQ ID NO: 199 is the determined extended cDNA sequence for 1H-4772
SEQ ID NO: 200 is the determined extended cDNA sequence for 1D-4309
SEQ ID NO: 201 is the determined extended cDNA sequence for 1D.1-4278
SEQ ID NO: 202 is the determined extended cDNA sequence for 1D-4288
SEQ ID NO: 203 is the determined extended cDNA sequence for ID-4283

SEQ ID NO: 204 is the determined extended cDNA sequence for ID-4304
SEQ ID NO: 205 is the determined extended cDNA sequence for ID-4296
SEQ ID NO: 206 is the determined extended cDNA sequence for ID-4280
SEQ ID NO: 207 is the determined cDNA sequence for 10-d8fwd
SEQ ID NO: 208 is the determined cDNA sequence for 10-H10con
SEQ ID NO: 209 is the determined cDNA sequence for 11-C8rev
SEQ ID NO: 210 is the determined cDNA sequence for 7.g6fwd
SEQ ID NO: 211 is the determined cDNA sequence for 7.g6rev
SEQ ID NO: 212 is the determined cDNA sequence for 8-b5fwd
SEQ ID NO: 213 is the determined cDNA sequence for 8-b5rev
SEQ ID NO: 214 is the determined cDNA sequence for 8-b6fwd
SEQ ID NO: 215 is the determined cDNA sequence for 8-b6 rev
SEQ ID NO: 216 is the determined cDNA sequence for 8-d4fwd
SEQ ID NO: 217 is the determined cDNA sequence for 8-d9rev
SEQ ID NO: 218 is the determined cDNA sequence for 8-g3fwd
SEQ ID NO: 219 is the determined cDNA sequence for 8-g3rev
SEQ ID NO: 220 is the determined cDNA sequence for 8-h11rev
SEQ ID NO: 221 is the determined cDNA sequence for g-f12fwd
SEQ ID NO: 222 is the determined cDNA sequence for g-f3rev
SEQ ID NO: 223 is the determined cDNA sequence for P509S
SEQ ID NO: 224 is the determined cDNA sequence for P510S
SEQ ID NO: 225 is the determined cDNA sequence for P703DE5
SEQ ID NO: 226 is the determined cDNA sequence for 9-A11
SEQ ID NO: 227 is the determined cDNA sequence for 8-C6
SEQ ID NO: 228 is the determined cDNA sequence for 8-H7
SEQ ID NO: 229 is the determined cDNA sequence for JPTPN13
SEQ ID NO: 230 is the determined cDNA sequence for JPTPN14
SEQ ID NO: 231 is the determined cDNA sequence for JPTPN23
SEQ ID NO: 232 is the determined cDNA sequence for JPTPN24
SEQ ID NO: 233 is the determined cDNA sequence for JPTPN25
SEQ ID NO: 234 is the determined cDNA sequence for JPTPN30
SEQ ID NO: 235 is the determined cDNA sequence for JPTPN34
SEQ ID NO: 236 is the determined cDNA sequence for PTPN35
SEQ ID NO: 237 is the determined cDNA sequence for JPTPN36
SEQ ID NO: 238 is the determined cDNA sequence for JPTPN38
SEQ ID NO: 239 is the determined cDNA sequence for JPTPN39
SEQ ID NO: 240 is the determined cDNA sequence for JPTPN40
SEQ ID NO: 241 is the determined cDNA sequence for JPTPN41
SEQ ID NO: 242 is the determined cDNA sequence for JPTPN42
SEQ ID NO: 243 is the determined cDNA sequence for JPTPN45
SEQ ID NO: 244 is the determined cDNA sequence for JPTPN46
SEQ ID NO: 245 is the determined cDNA sequence for JPTPN51
SEQ ID NO: 246 is the determined cDNA sequence for JPTPN56
SEQ ID NO: 247 is the determined cDNA sequence for PTPN64
SEQ ID NO: 248 is the determined cDNA sequence for JPTPN65
SEQ ID NO: 249 is the determined cDNA sequence for JPTPN67
SEQ ID NO: 250 is the determined cDNA sequence for JPTPN76
SEQ ID NO: 251 is the determined cDNA sequence for JPTPN84
SEQ ID NO: 252 is the determined cDNA sequence for JPTPN85
SEQ ID NO: 253 is the determined cDNA sequence for JPTPN86
SEQ ID NO: 254 is the determined cDNA sequence for JPTPN87
SEQ ID NO: 255 is the determined cDNA sequence for JPTPN88
SEQ ID NO: 256 is the determined cDNA sequence for JP1F1
SEQ ID NO: 257 is the determined cDNA sequence for JP1F2
SEQ ID NO: 258 is the determined cDNA sequence for JP1C2
SEQ ID NO: 259 is the determined cDNA sequence for JP1B1
SEQ ID NO: 260 is the determined cDNA sequence for JP1B2
SEQ ID NO: 261 is the determined cDNA sequence for JP1D3
SEQ ID NO: 262 is the determined cDNA sequence for JP1A4
SEQ ID NO: 263 is the determined cDNA sequence for JP1F5
SEQ ID NO: 264 is the determined cDNA sequence for JP1E6
SEQ ID NO: 265 is the determined cDNA sequence for JP1D6

SEQ ID NO: 266 is the determined cDNA sequence for JP1B5

SEQ ID NO: 267 is the determined cDNA sequence for JP1A6

SEQ ID NO: 268 is the determined cDNA sequence for JP1E8

SEQ ID NO: 269 is the determined cDNA sequence for JP1D7

SEQ ID NO: 270 is the determined cDNA sequence for JP1D9

SEQ ID NO: 271 is the determined cDNA sequence for JP1C10

SEQ ID NO: 272 is the determined cDNA sequence for JP1A9

SEQ ID NO: 273 is the determined cDNA sequence for JP1F12

SEQ ID NO: 274 is the determined cDNA sequence for JP1E12

SEQ ID NO: 275 is the determined cDNA sequence for JP1D11

SEQ ID NO: 276 is the determined cDNA sequence for JP1C11

SEQ ID NO: 277 is the determined cDNA sequence for JP1C12

SEQ ID NO: 278 is the determined cDNA sequence for JP1B12

SEQ ID NO: 279 is the determined cDNA sequence for JP1A12

SEQ ID NO: 280 is the determined cDNA sequence for JP8G2

SEQ ID NO: 281 is the determined cDNA sequence for JP8H1

SEQ ID NO: 282 is the determined cDNA sequence for JP8H2

SEQ ID NO: 283 is the determined cDNA sequence for JP8A3

SEQ ID NO: 284 is the determined cDNA sequence for JP8A4

SEQ ID NO: 285 is the determined cDNA sequence for JP8C3

SEQ ID NO: 286 is the determined cDNA sequence for JP8G4

SEQ ID NO: 287 is the determined cDNA sequence for JP8B6

SEQ ID NO: 288 is the determined cDNA sequence for JP8D6

SEQ ID NO: 289 is the determined cDNA sequence for JP8F5

SEQ ID NO: 290 is the determined cDNA sequence for JP8A8

SEQ ID NO: 291 is the determined cDNA sequence for JP8D7

SEQ ID NO: 292 is the determined cDNA sequence for JP8D7

SEQ ID NO: 293 is the determined cDNA sequence for JP8D8

SEQ ID NO: 294 is the determined cDNA sequence for JP8E7

SEQ ID NO: 295 is the determined cDNA sequence for JP8F8

SEQ ID NO: 296 is the determined cDNA sequence for JP8G8

SEQ ID NO: 297 is the determined cDNA sequence for JP8B10

SEQ ID NO: 298 is the determined cDNA sequence for JP8C10

SEQ ID NO: 299 is the determined cDNA sequence for JP8E9

SEQ ID NO: 300 is the determined cDNA sequence for JP8E10

SEQ ID NO: 301 is the determined cDNA sequence for JP8F9

SEQ ID NO: 302 is the determined cDNA sequence for JP8H9

SEQ ID NO: 303 is the determined cDNA sequence for JP8C12

SEQ ID NO: 304 is the determined cDNA sequence for JP8E11

SEQ ID NO: 305 is the determined cDNA sequence for JP8E12

SEQ ID NO: 306 is the amino acid sequence for the peptide PS2#12

SEQ ID NO: 307 is the determined cDNA sequence for P711P

SEQ ID NO: 308 is the determined cDNA sequence for P712P

SEQ ID NO: 309 is the determined cDNA sequence for CLONE23

SEQ ID NO: 310 is the determined cDNA sequence for P774P

SEQ ID NO: 311 is the determined cDNA sequence for P775P

SEQ ID NO: 312 is the determined cDNA sequence for P715P

SEQ ID NO: 313 is the determined cDNA sequence for P710P

SEQ ID NO: 314 is the determined cDNA sequence for P767P

SEQ ID NO: 315 is the determined cDNA sequence for P768P

SEQ ID NO: 316–325 are the determined cDNA sequences of previously isolated genes SEQ ID NO: 326 is the determined cDNA sequence for P703PDE5

SEQ ID NO: 327 is the predicted amino acid sequence for P703PDE5

SEQ ID NO: 328 is the determined cDNA sequence for P703P6.26

SEQ ID NO: 329 is the predicted amino acid sequence for P703P6.26

SEQ ID NO: 330 is the determined cDNA sequence for P703PX-23

SEQ ID NO: 331 is the predicted amino acid sequence for P703PX-23

SEQ ID NO: 332 is the determined full length cDNA sequence for P509S

SEQ ID NO: 333 is the determined extended cDNA sequence for P707P (also referred to as 11-C9)

SEQ ID NO: 334 is the determined cDNA sequence for P714P

SEQ ID NO: 335 is the determined cDNA sequence for P705P (also referred to as 9-F3)

SEQ ID NO: 336 is the predicted amino acid sequence for P705P

SEQ ID NO: 337 is the amino acid sequence of the peptide P1S#10

SEQ ID NO: 338 is the amino acid sequence of the peptide p5

SEQ ID NO: 339 is the predicted amino acid sequence of P509S

SEQ ID NO: 340 is the determined cDNA sequence for P778P

SEQ ID NO: 341 is the determined cDNA sequence for P786P

SEQ ID NO: 342 is the determined cDNA sequence for P789P

SEQ ID NO: 343 is the determined cDNA sequence for a clone showing homology to Homo sapiens MM46 mRNA SEQ ID NO: 344 is the determined cDNA sequence for a clone showing homology to Homo sapiens TNF-alpha stimulated ABC protein (ABC50) mRNA SEQ ID NO: 345 is the determined cDNA sequence for a clone showing homology to Homo sapiens mRNA for E-cadherin SEQ ID NO: 346 is the determined cDNA sequence for a clone showing homology to Human nuclear-encoded mitochondrial serine hydroxymethyltransferase (SHMT)

SEQ ID NO: 347 is the determined cDNA sequence for a clone showing homology to Homo sapiens natural resistance-associated macrophage protein2 (NRAMP2)

SEQ ID NO: 348 is the determined cDNA sequence for a clone showing homology to Homo sapiens phosphoglucomutase-related protein (PGMRP)

SEQ ID NO: 349 is the determined cDNA sequence for a clone showing homology to Human mRNA for proteosome subunit p40

SEQ ID NO: 350 is the determined cDNA sequence for P777P

SEQ ID NO: 351 is the determined cDNA sequence for P779P

SEQ ID NO: 352 is the determined cDNA sequence for P790P

SEQ ID NO: 353 is the determined cDNA sequence for P784P

SEQ ID NO: 354 is the determined cDNA sequence for P776P

SEQ ID NO: 355 is the determined cDNA sequence for P780P

SEQ ID NO: 356 is the determined cDNA sequence for P544S

SEQ ID NO: 357 is the determined cDNA sequence for P745S

SEQ ID NO: 358 is the determined cDNA sequence for P782P

SEQ ID NO: 359 is the determined cDNA sequence for P783P

SEQ ID NO: 360 is the determined cDNA sequence for unknown 17984

SEQ ID NO: 361 is the determined cDNA sequence for P787P

SEQ ID NO: 362 is the determined cDNA sequence for P788P

SEQ ID NO: 363 is the determined cDNA sequence for unknown 17994

SEQ ID NO: 364 is the determined cDNA sequence for P781P

SEQ ID NO: 365 is the determined cDNA sequence for P785P

SEQ ID NO: 366–375 are the determined cDNA sequences for splice variants of B305D.

SEQ ID NO: 376 is the predicted amino acid sequence encoded by the sequence of SEQ ID NO: 366.

SEQ ID NO: 377 is the predicted amino acid sequence encoded by the sequence of SEQ ID NO: 372.

SEQ ID NO: 378 is the predicted amino acid sequence encoded by the sequence of SEQ ID NO: 373.

SEQ ID NO: 379 is the predicted amino acid sequence encoded by the sequence of SEQ ID NO: 374.

SEQ ID NO: 380 is the predicted amino acid sequence encoded by the sequence of SEQ ID NO: 375.

SEQ ID NO: 381 is the determined cDNA sequence for B716P.

SEQ ID NO: 382 is the determined full-length cDNA sequence for P711P.

SEQ ID NO: 383 is the predicted amino acid sequence for P711P.

SEQ ID NO: 384 is the cDNA sequence for P1000C.

SEQ ID NO: 385 is the cDNA sequence for CGI-82.

SEQ ID NO:386 is the cDNA sequence for 23320.

SEQ ID NO:387 is the cDNA sequence for CGI-69.

SEQ ID NO:388 is the cDNA sequence for L-iditol-2-dehydrogenase.

SEQ ID NO:389 is the cDNA sequence for 23379.

SEQ ID NO:390 is the cDNA sequence for 23381.

SEQ ID NO:391 is the cDNA sequence for KIAA0122.

SEQ ID NO:392 is the cDNA sequence for 23399.

SEQ ID NO:393 is the cDNA sequence for a previously identified gene.

SEQ ID NO:394 is the cDNA sequence for HCLBP.

SEQ ID NO:395 is the cDNA sequence for transglutaminase.

SEQ ID NO:396 is the cDNA sequence for a previously identified gene.

SEQ ID NO:397 is the cDNA sequence for PAP.

SEQ ID NO:398 is the cDNA sequence for Ets transcription factor PDEF.

SEQ ID NO:399 is the cDNA sequence for hTGR.

SEQ ID NO:400 is the cDNA sequence for KIAA0295.

SEQ ID NO:401 is the cDNA sequence for 22545.

SEQ ID NO:402 is the cDNA sequence for 22547.

SEQ ID NO:403 is the cDNA sequence for 22548.

SEQ ID NO:404 is the cDNA sequence for 22550.

SEQ ID NO:405 is the cDNA sequence for 22551.

SEQ ID NO:406 is the cDNA sequence for 22552.

SEQ ID NO:407 is the cDNA sequence for 22553 (also known as P1020C).

SEQ ID NO:408 is the cDNA sequence for 22558.

SEQ ID NO:409 is the cDNA sequence for 22562.

SEQ ID NO:410 is the cDNA sequence for 22565.

SEQ ID NO:411 is the cDNA sequence for 22567.

SEQ ID NO:412 is the cDNA sequence for 22568.

SEQ ID NO:413 is the cDNA sequence for 22570.

SEQ ID NO:414 is the cDNA sequence for 22571.

SEQ ID NO:415 is the cDNA sequence for 22572.
SEQ ID NO:416 is the cDNA sequence for 22573.
SEQ ID NO:417 is the cDNA sequence for 22573.
SEQ ID NO:418 is the cDNA sequence for 22575.
SEQ ID NO:419 is the cDNA sequence for 22580.
SEQ ID NO:420 is the cDNA sequence for 22581.
SEQ ID NO:421 is the cDNA sequence for 22582.
SEQ ID NO:422 is the cDNA sequence for 22583.
SEQ ID NO:423 is the cDNA sequence for 22584.
SEQ ID NO:424 is the cDNA sequence for 22585.
SEQ ID NO:425 is the cDNA sequence for 22586.
SEQ ID NO:426 is the cDNA sequence for 22587.
SEQ ID NO:427 is the cDNA sequence for 22588.
SEQ ID NO:428 is the cDNA sequence for 22589.
SEQ ID NO:429 is the cDNA sequence for 22590.
SEQ ID NO:430 is the cDNA sequence for 22591.
SEQ ID NO:431 is the cDNA sequence for 22592.
SEQ ID NO:432 is the cDNA sequence for 22593.
SEQ ID NO:433 is the cDNA sequence for 22594.
SEQ ID NO:434 is the cDNA sequence for 22595.
SEQ ID NO:435 is the cDNA sequence for 22596.
SEQ ID NO:436 is the cDNA sequence for 22847.
SEQ ID NO:437 is the cDNA sequence for 22848.
SEQ ID NO:438 is the cDNA sequence for 22849.
SEQ ID NO:439 is the cDNA sequence for 22851.
SEQ ID NO:440 is the cDNA sequence for 22852.
SEQ ID NO:441 is the cDNA sequence for 22853.
SEQ ID NO:442 is the cDNA sequence for 22854.
SEQ ID NO:443 is the cDNA sequence for 22855.
SEQ ID NO:444 is the cDNA sequence for 22856.
SEQ ID NO:445 is the cDNA sequence for 22857.
SEQ ID NO:446 is the cDNA sequence for 23601.
SEQ ID NO:447 is the cDNA sequence for 23602.
SEQ ID NO:448 is the cDNA sequence for 23605.
SEQ ID NO:449 is the cDNA sequence for 23606.
SEQ ID NO:450 is the cDNA sequence for 23612.
SEQ ID NO:451 is the cDNA sequence for 23614.
SEQ ID NO:452 is the cDNA sequence for 23618.
SEQ ID NO:453 is the cDNA sequence for 23622.
SEQ ID NO:454 is the cDNA sequence for folate hydrolase.
SEQ ID NO:455 is the cDNA sequence for LIM protein.
SEQ ID NO:456 is the cDNA sequence for a known gene.
SEQ ID NO:457 is the cDNA sequence for a known gene.
SEQ ID NO:458 is the cDNA sequence for a previously identified gene.
SEQ ID NO:459 is the cDNA sequence for 23045.
SEQ ID NO:460 is the cDNA sequence for 23032.
SEQ ID NO:461 is the cDNA sequence for clone 23054.
SEQ ID NO:462–467 are cDNA sequences for known genes.
SEQ ID NO:468–471 are cDNA sequences for P710P.
SEQ ID NO:472 is a cDNA sequence for P1001C.
SEQ ID NO: 473 is the determined cDNA sequence for a first splice variant of P775P (referred to as 27505).
SEQ ID NO: 474 is the determined cDNA sequence for a second splice variant of P775P (referred to as 19947).
SEQ ID NO: 475 is the determined cDNA sequence for a third splice variant of P775P (referred to as 19941).
SEQ ID NO: 476 is the determined cDNA sequence for a fourth splice variant of P775P (referred to as 19937).
SEQ ID NO: 477 is a first predicted amino acid sequence encoded by the sequence of SEQ ID NO: 474.
SEQ ID NO: 478 is a second predicted amino acid sequence encoded by the sequence of SEQ ID NO: 474.
SEQ ID NO: 479 is the predicted amino acid sequence encoded by the sequence of SEQ ID NO: 475.
SEQ ID NO: 480 is a first predicted amino acid sequence encoded by the sequence of SEQ ID NO: 473.
SEQ ID NO: 481 is a second predicted amino acid sequence encoded by the sequence of SEQ ID NO: 473.
SEQ ID NO: 482 is a third predicted amino acid sequence encoded by the sequence of SEQ ID NO: 473.
SEQ ID NO: 483 is a fourth predicted amino acid sequence encoded by the sequence of SEQ ID NO: 473.
SEQ ID NO: 484 is the first 30 amino acids of the *M. tuberculosis* antigen Ra12.
SEQ ID NO: 485 is the PCR primer AW025.

SEQ ID NO: 486 is the PCR primer AW003.

SEQ ID NO: 487 is the PCR primer AW027.

SEQ ID NO: 488 is the PCR primer AW026.

SEQ ID NO: 489–501 are peptides employed in epitope mapping studies.

SEQ ID NO: 502 is the determined cDNA sequence of the complementarity determining region for the anti-P503S monoclonal antibody 20D4.

SEQ ID NO: 503 is the determined cDNA sequence of the complementarity determining region for the anti-P503S monoclonal antibody JA1.

SEQ ID NO: 504 & 505 are peptides employed in epitope mapping studies.

SEQ ID NO: 506 is the determined cDNA sequence of the complementarity determining region for the anti-P703P monoclonal antibody 8H2.

SEQ ID NO: 507 is the determined cDNA sequence of the complementarity determining region for the anti-P703P monoclonal antibody 7H8.

SEQ ID NO: 508 is the determined cDNA sequence of the complementarity determining region for the anti-P703P monoclonal antibody 2D4.

SEQ ID NO: 509–522 are peptides employed in epitope mapping studies.

SEQ ID NO: 523 is a mature form of P703P used to raise antibodies against P703P.

SEQ ID NO: 524 is the putative full-length cDNA sequence of P703P.

SEQ ID NO: 525 is the predicted amino acid sequence encoded by SEQ ID NO: 524.

SEQ ID NO: 526 is the full-length cDNA sequence for P790P.

SEQ ID NO: 527 is the predicted amino acid sequence for P790P.

SEQ ID NO: 528 & 529 are PCR primers.

SEQ ID NO: 530 is the cDNA sequence of a splice variant of SEQ ID NO: 366.

SEQ ID NO: 531 is the cDNA sequence of the open reading frame of SEQ ID NO: 530.

SEQ ID NO: 532 is the predicted amino acid encoded by the sequence of SEQ ID NO: 531.

SEQ ID NO: 533 is the DNA sequence of a putative ORF of P775P.

SEQ ID NO: 534 is the predicted amino acid sequence encoded by SEQ ID NO: 533.

SEQ ID NO: 535 is a first full-length cDNA sequence for P510S.

SEQ ID NO: 536 is a second full-length cDNA sequence for P510S.

SEQ ID NO: 537 is the predicted amino acid sequence encoded by SEQ ID NO: 535.

SEQ ID NO: 538 is the predicted amino acid sequence encoded by SEQ ID NO: 536.

SEQ ID NO: 539 is the peptide P501S-370.

SEQ ID NO: 540 is the peptide P501S-376.

SEQ ID NO: 541–551 are epitopes of P501S.

SEQ ID NO: 552 is an extended cDNA sequence for P712P.

SEQ ID NO: 553–568 are the amino acid sequences encoded by predicted open reading frames within SEQ ID NO: 552.

SEQ ID NO: 569 is an extended cDNA sequence for P776P.

SEQ ID NO: 570 is the determined cDNA sequence for a splice variant of P776P referred to as contig 6.

SEQ ID NO: 571 is the determined cDNA sequence for a splice variant of P776P referred to as contig 7.

SEQ ID NO: 572 is the determined cDNA sequence for a splice variant of P776P referred to as contig 14.

SEQ ID NO: 573 is the amino acid sequence encoded by a first predicted ORF of SEQ ID NO: 570.

SEQ ID NO: 574 is the amino acid sequence encoded by a second predicted ORF of SEQ ID NO: 570.

SEQ ID NO: 575 is the amino acid sequence encoded by a predicted ORF of SEQ ID NO: 571.

SEQ ID NO: 576–586 are amino acid sequences encoded by predicted ORFs of SEQ ID NO: 569.

SEQ ID NO: 587 is a DNA consensus sequence of the sequences of P767P and P777P.

SEQ ID NO: 588–590 are amino acid sequences encoded by predicted ORFs of SEQ ID NO: 587.

SEQ ID NO: 591 is an extended cDNA sequence for P1020C.

SEQ ID NO: 592 is the predicted amino acid sequence encoded by the sequence of SEQ ID NO: P1020C.

SEQ ID NO: 593 is a splice variant of P775P referred to as 50748.

SEQ ID NO: 594 is a splice variant of P775P referred to as 50717. SEQ ID NO: 595 is a splice variant of P775P referred to as 45985.

SEQ ID NO: 596 is a splice variant of P775P referred to as 38769.

SEQ ID NO: 597 is a splice variant of P775P referred to as 37922.

SEQ ID NO: 598 is a splice variant of P510S referred to as 49274.

SEQ ID NO: 599 is a splice variant of P510S referred to as 39487.

SEQ ID NO: 600 is a splice variant of P504S referred to as 5167.16.

SEQ ID NO: 601 is a splice variant of P504S referred to as 5167.1.

SEQ ID NO: 602 is a splice variant of P504S referred to as 5163.46.

SEQ ID NO: 603 is a splice variant of P504S referred to as 5163.42.

SEQ ID NO: 604 is a splice variant of P504S referred to as 5163.34.

SEQ ID NO: 605 is a splice variant of P504S referred to as 5163.17.

SEQ ID NO: 606 is a splice variant of P501S referred to as 10640.

SEQ ID NO: 607–615 are the sequences of PCR primers.

SEQ ID NO: 616 is the determined cDNA sequence of a fusion of P703P and PSA.

SEQ ID NO: 617 is the amino acid sequence of the fusion of P703P and PSA.

SEQ ID NO: 618–689 are determined cDNA sequences of prostate-specific clones.

SEQ ID NO: 690 is the cDNA sequence of the gene DD3.

SEQ ID NO: 691–697 are determined cDNA sequences of prostate-specific clones.

SEQ ID NO: 698 is an extended cDNA sequence for P714P.

SEQ ID NO: 699–701 are the cDNA sequences for splice variants of P704P.

SEQ ID NO: 702 is the cDNA sequence of a spliced variant of P553S referred to as P553S-14.

SEQ ID NO: 703 is the cDNA sequence of a spliced variant of P553S referred to as P553S-12.

SEQ ID NO: 704 is the cDNA sequence of a spliced variant of P553S referred to as P553S-10.

SEQ ID NO: 705 is the cDNA sequence of a spliced variant of P553S referred to as P553S-6.

SEQ ID NO: 706 is the amino acid sequence encoded by SEQ ID NO: 705.

SEQ ID NO: 707 is the amino acid sequence encoded by SEQ ID NO: 702 SEQ ID NO: 708 is a second amino acid sequence encoded by SEQ ID NO: 702.

SEQ ID NO: 709–772 are determined cDNA sequences of prostate-specific clones.

SEQ ID NO: 773 is a first full-length cDNA sequence for prostate-specific transglutaminase gene (also referred to herein as P558S).

SEQ ID NO: 774 is a second full-length cDNA sequence for prostate-specific transglutaminase gene.

SEQ ID NO: 775 is the amino acid sequence encoded by the sequence of SEQ ID NO: 773.

SEQ ID NO: 776 is the amino acid sequence encoded by the sequence of SEQ ID NO: 774.

SEQ ID NO: 777 is the full-length cDNA sequence for P788P.

SEQ ID NO: 778 is the amino acid sequence encoded by SEQ ID NO: 777.

SEQ ID NO: 779 is the determined cDNA sequence for a polymorphic variant of P788P.

SEQ ID NO: 780 is the amino acid sequence encoded by SEQ ID NO: 779.

SEQ ID NO: 781 is the amino acid sequence of peptide 4 from P703P.

SEQ ID NO: 782 is the cDNA sequence that encodes peptide 4 from P703P.

SEQ ID NO: 783–798 are the cDNA sequence encoding epitopes of P703P.

SEQ ID NO: 799–814 are the amino acid sequences of epitopes of P703P.

SEQ ID NO: 815 and 816 are PCR primers.

SEQ ID NO: 817 is the cDNA sequence encoding an N-terminal portion of P788P expressed in E. coli.

SEQ ID NO: 818 is the amino acid sequence of the N-terminal portion of P788P expressed in E. coli.

SEQ ID NO: 819 is the amino acid sequence of the M. tuberculosis antigen Ra12.

SEQ ID NO: 820 and 821 are PCR primers.

SEQ ID NO: 822 is the cDNA sequence for the Ra12-P510S-C construct.

SEQ ID NO: 823 is the cDNA sequence for the P510S-C construct.

SEQ ID NO: 824 is the cDNA sequence for the P510S-E3 construct.

SEQ ID NO: 825 is the amino acid sequence for the Ra12-P510S-C construct.

SEQ ID NO: 826 is the amino acid sequence for the P510S-C construct.

SEQ ID NO: 827 is the amino acid sequence for the P510S-E3 construct.

SEQ ID NO: 828–833 are PCR primers.

SEQ ID NO: 834 is the cDNA sequence of the construct Ra12-P775P-ORF3.

SEQ ID NO: 835 is the amino acid sequence of the construct Ra12-P775P-ORF3.

SEQ ID NO: 836 and 837 are PCR primers.

SEQ ID NO: 838 is the determined amino acid sequence for a P703P His tag fusion protein.

SEQ ID NO: 839 is the determined cDNA sequence for a P703P His tag fusion protein.

SEQ ID NO: 840 and 841 are PCR primers.

SEQ ID NO: 842 is the determined amino acid sequence for a P705P His tag fusion protein.

SEQ ID NO: 843 is the determined cDNA sequence for a P705P His tag fusion protein.

SEQ ID NO: 844 and 845 are PCR primers.

SEQ ID NO: 846 is the determined amino acid sequence for a P711P His tag fusion protein.

SEQ ID NO: 847 is the determined cDNA sequence for a P711P His tag fusion protein.

SEQ ID NO: 848 is the amino acid sequence of the M. tuberculosis antigen Ra12.

SEQ ID NO: 849 and 850 are PCR primers.

SEQ ID NO: 851 is the determined cDNA sequence for the construct Ra12-P501S-E2.

SEQ ID NO: 852 is the determined amino acid sequence for the construct Ra12-P501S-E2.

SEQ ID NO: 853 is the amino acid sequence for an epitope of P501S.

SEQ ID NO: 854 is the DNA sequence encoding SEQ ID NO: 853.

SEQ ID NO: 855 is the amino acid sequence for an epitope of P501S.

SEQ ID NO: 856 is the DNA sequence encoding SEQ ID NO: 855.

SEQ ID NO: 857 is a peptide employed in epitope mapping studies.

SEQ ID NO: 858 is the amino acid sequence for an epitope of P501S.

SEQ ID NO: 859 is the DNA sequence encoding SEQ ID NO: 858.

SEQ ID NO: 860–862 are the amino acid sequences for CD4 epitopes of P501S.

SEQ ID NO: 863–865 are the DNA sequences encoding the sequences of SEQ ID NO: 860–862.

SEQ ID NO: 866–877 are the amino acid sequences for putative CTL epitopes of P703P.

SEQ ID NO: 878 is the full-length cDNA sequence for P789P.

SEQ ID NO: 879 is the amino acid sequence encoded by SEQ ID NO: 878.

SEQ ID NO: 880 is the determined full-length cDNA sequence for the splice variant of P776P referred to as contig 6.

SEQ ID NO: 881–882 are determined full-length cDNA sequences for the splice variant of P776P referred to as contig 7.

SEQ ID NO: 883–887 are amino acid sequences encoded by SEQ ID NO: 880.

SEQ ID NO: 888–893 are amino acid sequences encoded by the splice variant of P776P referred to as contig 7.

SEQ ID NO: 894 is the full-length cDNA sequence for human transmembrane protease serine 2.

SEQ ID NO: 895 is the amino acid sequence encoded by SEQ ID NO: 894.

DETAILED DESCRIPTION OF THE INVENTION

The present invention is directed generally to compositions and their use in the therapy and diagnosis of cancer, particularly prostate cancer. As described further below, illustrative compositions of the present invention include, but are not restricted to, polyp eptides, particularly immunogenic polypeptides, polynucleotides encoding such polypeptides, antibodies and other binding agents, antigen presenting cells (APCs) and immune system cells (e.g., T cells).

The practice of the present invention will employ, unless indicated specifically to the contrary, conventional methods of virology, immunology, microbiology, molecular biology and recombinant DNA techniques within the skill of the art, many of which are described below for the purpose of illustration. Such techniques are explained fully in the literature. See, e.g., Sambrook, et al. Molecular Cloning: A Laboratory Manual (2nd Edition, 1989); Maniatis et al. Molecular Cloning: A Laboratory Manual (1982); DNA Cloning: A Practical Approach, vol. I & II (D. Glover, ed.); Oligonucleotide Synthesis (N. Gait, ed., 1984); Nucleic Acid Hybridization (B. Hames & S. Higgins, eds., 1985); Transcription and Translation (B. Hames & S. Higgins, eds., 1984); Animal Cell Culture (R. Freshney, ed., 1986); Perbal, A Practical Guide to Molecular Cloning (1984).

All publications, patents and patent applications cited herein, whether supra or infra, are hereby incorporated by reference in their entirety.

As used in this specification and the appended claims, the singular forms "a," "an" and "the" include plural references unless the content clearly dictates otherwise.

Polypeptide Compositions

As used herein, the term "polypeptide" " is used in its conventional meaning, i.e., as a sequence of amino acids. The polypeptides are not limited to a specific length of the product; thus, peptides, oligopeptides, and proteins are included within the definition of polypeptide, and such terms may be used interchangeably herein unless specifically indicated otherwise. This term also does not refer to or exclude post-expression modifications of the polypeptide, for example, glycosylations, acetylations, phosphorylations and the like, as well as other modifications known in the art, both naturally occurring and non-naturally occurring. A polypeptide may be an entire protein, or a subsequence thereof. Particular polypeptides of interest in the context of this invention are amino acid subsequences comprising epitopes, i.e., antigenic determinants substantially responsible for the immunogenic properties of a polypeptide and being capable of evoking an immune response.

Particularly illustrative polypeptides of the present invention comprise those encoded by a polynucleotide sequence set forth in any one of SEQ ID NOs: 1–111, 115–171, 173–175, 177, 179–305, 307–315, 326, 328, 330, 332–335, 340–375, 381, 382 and 384–476, 524, 526, 530, 531, 533, 535, 536, 552, 569–572, 587, 591, 593–606, 618–705, 709–774, 777, 789, 817, 823, 824, 878, 880–882 and 894, or a sequence that hybridizes under moderately stringent conditions, or, alternatively, under highly stringent conditions, to a polynucleotide sequence set forth in any one of SEQ ID NOs: 1–111, 115–171, 173–175, 177, 179–305, 307–315, 326, 328, 330, 332–335, 340–375, 381, 382 and 384–476, 524, 526, 530, 531, 533, 535, 536, 552, 569–572, 587, 591, 593–606, 618–705, 709–774, 777, 789, 817, 823, 824, 878, 880–882 and 894. In specific embodiments, the polypeptides of the invention comprise amino acid sequences as set forth in any one of SEQ ID NO: 112–114, 172, 176, 178, 327, 329, 331, 336, 339, 376–380, 383, 477–483, 496, 504, 505, 519, 520, 522, 525, 527, 532, 534, 537–551, 553–568, 573–586, 588–590, 592, 706–708, 775, 776, 778, 780, 781, 811, 814, 818, 826, 827, 853, 855, 858, 860–862, 866–877, 879, 883–893 and 895.

The polypeptides of the present invention are sometimes herein referred to as prostate-specific proteins or prostate-specific polypeptides, as an indication that their identification has been based at least in part upon their increased levels of expression in prostate tissue samples. Thus, a "prostate-specific polypeptide" or "prostate-specific protein," refers generally to a polypeptide sequence of the present invention, or a polynucleotide sequence encoding such a polypeptide, that is expressed in a substantial proportion of prostate tissue samples, for example preferably greater than about 20%, more preferably greater than about 30%, and most preferably greater than about 50% or more of prostate tissue samples tested, at a level that is at least two fold, and preferably at least five fold, greater than the level of expression in other normal tissues, as determined using a representative assay provided herein. A prostate-specific polypeptide sequence of the invention, based upon its increased level of expression in tumor cells, has particular utility both as a diagnostic marker as well as a therapeutic target, as further described below.

In certain preferred embodiments, the polypeptides of the invention are immunogenic, i.e., they react detectably within an immunoassay (such as an ELISA or T-cell stimulation assay) with antisera and/or T-cells from a patient with prostate cancer. Screening for immunogenic activity can be performed using techniques well known to the skilled artisan. For example, such screens can be performed using methods such as those described in Harlow and Lane, *Antibodies: A Laboratory Manual*, Cold Spring Harbor Laboratory, 1988. In one illustrative example, a polypeptide may be immobilized on a solid support and contacted with patient sera to allow binding of antibodies within the sera to the immobilized polypeptide. Unbound sera may then be removed and bound antibodies detected using, for example, $^{125}$I-labeled Protein A.

As would be recognized by the skilled artisan, immunogenic portions of the polypeptides disclosed herein are also encompassed by the present invention. An "immunogenic portion," as used herein, is a fragment of an immunogenic polypeptide of the invention that itself is immunologically reactive (i.e., specifically binds) with the B-cells and/or T-cell surface antigen receptors that recognize the polypeptide. Immunogenic portions may generally be identified using well known techniques, such as those summarized in Paul, *Fundamental Immunology*, 3rd ed., 243–247 (Raven Press, 1993) and references cited therein. Such techniques include screening polypeptides for the ability to react with antigen-specific antibodies, antisera and/or T-cell lines or clones. As used herein, antisera and antibodies are "antigen-specific" if they specifically bind to an antigen (i.e., they react with the protein in an ELISA or other immunoassay, and do not react detectably with unrelated proteins). Such antisera and antibodies may be prepared as described herein, and using well-known techniques.

In one preferred embodiment, an immunogenic portion of a polypeptide of the present invention is a portion that reacts with antisera and/or T-cells at a level that is not substantially less than the reactivity of the full-length polypeptide (e.g., in an ELISA and/or T-cell reactivity assay). Preferably, the level of immunogenic activity of the immunogenic portion is at least about 50%, preferably at least about 70% and most preferably greater than about 90% of the immunogenicity for the full-length polypeptide. In some instances, preferred immunogenic portions will be identified that have a level of immunogenic activity greater than that of the corresponding full-length polypeptide, e.g., having greater than about 100% or 150% or more immunogenic activity.

In certain other embodiments, illustrative immunogenic portions may include peptides in which an N-terminal leader sequence and/or transmembrane domain has been deleted. Other illustrative immunogenic portions will contain a small N- and/or C-terminal deletion (e.g., 1–30 amino acids, preferably 5–15 amino acids), relative to the mature protein.

In another embodiment, a polypeptide composition of the invention may also comprise one or more polypeptides that are immunologically reactive with T cells and/or antibodies generated against a polypeptide of the invention, particularly a polypeptide having an amino acid sequence disclosed herein, or to an immunogenic fragment or variant thereof.

In another embodiment of the invention, polypeptides are provided that comprise one or more polypeptides that are capable of eliciting T cells and/or antibodies that are immunologically reactive with one or more polypeptides described herein, or one or more polypeptides encoded by contiguous nucleic acid sequences contained in the polynucleotide sequences disclosed herein, or immunogenic fragments or variants thereof, or to one or more nucleic acid sequences which hybridize to one or more of these sequences under conditions of moderate to high stringency.

The present invention, in another aspect, provides polypeptide fragments comprising at least about 5, 10, 15, 20, 25, 50, or 100 contiguous amino acids, or more, including all intermediate lengths, of a polypeptide composition set forth herein, such as those set forth in SEQ ID NO: 112–114, 172, 176, 178, 327, 329, 331, 336, 339, 376–380, 383, 477–483, 496, 504, 505, 519, 520, 522, 525, 527, 532, 534, 537–551, 553–568, 573–586, 588–590, 592, 706–708, 775, 776, 778, 780, 781, 811, 814, 818, 826, 827, 853, 855, 858, 860–862, 866–877, 879, 883–893 and 895, or those encoded by a polynucleotide sequence set forth in a sequence of SEQ ID NO: 1–111, 115–171, 173–175, 177, 179–305, 307–315, 326, 328, 330, 332–335, 340–375, 381, 382 and 384–476, 524, 526, 530, 531, 533, 535, 536, 552, 569–572, 587, 591, 593–606, 618–705, 709–774, 777, 789, 817, 823, 824, 878, 880–882 and 894.

In another aspect, the present invention provides variants of the polypeptide compositions described herein. Polypeptide variants generally encompassed by the present invention will typically exhibit at least about 70%, 75%, 80%, 85%, 90%, 91%, 92%, 93%, 94%, 95%, 96%, 97%, 98%, or 99% or more identity (determined as described below), along its length, to a polypeptide sequence set forth herein.

In one preferred embodiment, the polypeptide fragments and variants provided by the present invention are immunologically reactive with an antibody and/or T-cell that reacts with a full-length polypeptide specifically set forth herein.

In another preferred embodiment, the polypeptide fragments and variants provided by the present invention exhibit a level of immunogenic activity of at least about 50%, preferably at least about 70%, and most preferably at least about 90% or more of that exhibited by a full-length polypeptide sequence specifically set forth herein.

A polypeptide "variant," as the term is used herein, is a polypeptide that typically differs from a polypeptide specifically disclosed herein in one or more substitutions, deletions, additions and/or insertions. Such variants may be naturally occurring or may be synthetically generated, for example, by modifying one or more of the above polypeptide sequences of the invention and evaluating their immunogenic activity as described herein using any of a number of techniques well known in the art.

For example, certain illustrative variants of the polypeptides of the invention include those in which one or more portions, such as an N-terminal leader sequence or transmembrane domain, have been removed. Other illustrative variants include variants in which a small portion (e.g., 1–30 amino acids, preferably 5–15 amino acids) has been removed from the N- and/or C-terminal of the mature protein.

In many instances, a variant will contain conservative substitutions. A "conservative substitution" is one in which an amino acid is substituted for another amino acid that has similar properties, such that one skilled in the art of peptide chemistry would expect the secondary structure and hydropathic nature of the polypeptide to be substantially unchanged. As described above, modifications may be made in the structure of the polynucleotides and polypeptides of the present invention and still obtain a functional molecule that encodes a variant or derivative polypeptide with desirable characteristics, e.g., with immunogenic characteristics. When it is desired to alter the amino acid sequence of a polypeptide to create an equivalent, or even an improved, immunogenic variant or portion of a polypeptide of the invention, one skilled in the art will typically change one or more of the codons of the encoding DNA sequence according to Table 1.

For example, certain amino acids may be substituted for other amino acids in a protein structure without appreciable loss of interactive binding capacity with structures such as, for example, antigen-binding regions of antibodies or binding sites on substrate molecules. Since it is the interactive capacity and nature of a protein that defines that protein's biological functional activity, certain amino acid sequence substitutions can be made in a protein sequence, and, of course, its underlying DNA coding sequence, and nevertheless obtain a protein with like properties. It is thus contemplated that various changes may be made in the peptide sequences of the disclosed compositions, or corresponding DNA sequences which encode said peptides without appreciable loss of their biological utility or activity.

TABLE 1

| Amino Acids | | | Codons | | | | | |
|---|---|---|---|---|---|---|---|---|
| Alanine | Ala | A | GCA | GCC | GCG | GCU | | |
| Cysteine | Cys | C | UGC | UGU | | | | |
| Aspartic acid | Asp | D | GAC | GAU | | | | |
| Glutamic acid | Glu | E | GAA | GAG | | | | |
| Phenylalanine | Phe | F | UUC | UUU | | | | |
| Glycine | Gly | G | GGA | GGC | GGG | GGU | | |
| Histidine | His | H | CAC | CAU | | | | |
| Isoleucine | Ile | I | AUA | AUC | AUU | | | |
| Lysine | Lys | K | AAA | AAG | | | | |
| Leucine | Leu | L | UUA | UUG | CUA | CUC | CUG | CUU |
| Methionine | Met | M | AUG | | | | | |
| Asparagine | Asn | N | AAC | AAU | | | | |
| Proline | Pro | P | CCA | CCC | CCG | CCU | | |
| Glutamine | Gln | Q | CAA | CAG | | | | |
| Arginine | Arg | R | AGA | AGG | CGA | CGC | CGG | CGU |
| Serine | Ser | S | AGC | AGU | UCA | UCC | UCG | UCU |
| Threonine | Thr | T | ACA | ACC | ACG | ACU | | |
| Valine | Val | V | GUA | GUC | GUG | GUU | | |
| Tryptophan | Trp | W | UGG | | | | | |
| Tyrosine | Tyr | Y | UAC | UAU | | | | |

In making such changes, the hydropathic index of amino acids may be considered. The importance of the hydropathic amino acid index in conferring interactive biologic function on a protein is generally understood in the art (Kyte and Doolittle, 1982, incorporated herein by reference). It is accepted that the relative hydropathic character of the amino acid contributes to the secondary structure of the resultant protein, which in turn defines the interaction of the protein with other molecules, for example, enzymes, substrates, receptors, DNA, antibodies, antigens, and the like. Each amino acid has been assigned a hydropathic index on the basis of its hydrophobicity and charge characteristics (Kyte and Doolittle, 1982). These values are: isoleucine (+4.5); valine (+4.2); leucine (+3.8); phenylalanine (+2.8); cysteine/cystine (+2.5); methionine (+1.9); alanine (+1.8); glycine (−0.4); threonine (−0.7); serine (−0.8); tryptophan (−0.9); tyrosine (−1.3); proline (−1.6); histidine (−3.2); glutamate (−3.5); glutamine (−3.5); aspartate (−3.5); asparagine (−3.5); lysine (−3.9); and arginine (−4.5).

It is known in the art that certain amino acids may be substituted by other amino acids having a similar hydropathic index or score and still result in a protein with similar biological activity, i.e. still obtain a biological functionally equivalent protein. In making such changes, the substitution of amino acids whose hydropathic indices are within ±2 is preferred, those within ±1 are particularly preferred, and those within ±0.5 are even more particularly preferred. It is also understood in the art that the substitution of like amino acids can be made effectively on the basis of hydrophilicity. U.S. Pat. No. 4,554,101 (specifically incorporated herein by reference in its entirety), states that the greatest local average hydrophilicity of a protein, as governed by the hydrophilicity of its adjacent amino acids, correlates with a biological property of the protein.

As detailed in U.S. Pat. No. 4,554,101, the following hydrophilicity values have been assigned to amino acid residues: arginine (+3.0); lysine (+3.0); aspartate (+3.0±1); glutamate (+3.0±1); serine (+0.3); asparagine (+0.2); glutamine (+0.2); glycine (0); threonine (−0.4); proline (−0.5±1); alanine (−0.5); histidine (−0.5); cysteine (−1.0); methionine (−1.3); valine (−1.5); leucine (−1.8); isoleucine (−1.8); tyrosine (−2.3); phenylalanine (−2.5); tryptophan (−3.4). It is understood that an amino acid can be substituted for another having a similar hydrophilicity value and still obtain a biologically equivalent, and in particular, an immunologically equivalent protein. In such changes, the substitution of amino acids whose hydrophilicity values are within ±2 is preferred, those within ±1 are particularly preferred, and those within ±0.5 are even more particularly preferred.

As outlined above, amino acid substitutions are generally therefore based on the relative similarity of the amino acid side-chain substituents, for example, their hydrophobicity, hydrophilicity, charge, size, and the like. Exemplary substitutions that take various of the foregoing characteristics into consideration are well known to those of skill in the art and include: arginine and lysine; glutamate and aspartate; serine and threonine; glutamine and asparagine; and valine, leucine and isoleucine.

In addition, any polynucleotide may be further modified to increase stability in vivo. Possible modifications include, but are not limited to, the addition of flanking sequences at the 5' and/or 3' ends; the use of phosphorothioate or 2' O-methyl rather than phosphodiesterase linkages in the backbone; and/or the inclusion of nontraditional bases such as inosine, queosine and wybutosine, as well as acetyl-methyl-, thio- and other modified forms of adenine, cytidine, guanine, thymine and uridine.

Amino acid substitutions may further be made on the basis of similarity in polarity, charge, solubility, hydrophobicity, hydrophilicity and/or the amphipathic nature of the residues. For example, negatively charged amino acids include aspartic acid and glutamic acid; positively charged amino acids include lysine and arginine; and amino acids with uncharged polar head groups having similar hydrophilicity values include leucine, isoleucine and valine; glycine and alanine; asparagine and glutamine; and serine, threonine, phenylalanine and tyrosine. Other groups of amino acids that may represent conservative changes include: (1) ala, pro, gly, glu, asp, gln, asn, ser, thr; (2) cys, ser, tyr, thr; (3) val, ile, leu, met, ala, phe; (4) lys, arg, his; and (5) phe, tyr, trp, his. A variant may also, or alternatively, contain nonconservative changes. In a preferred embodiment, variant polypeptides differ from a native sequence by substitution, deletion or addition of five amino acids or fewer. Variants may also (or alternatively) be modified by, for example, the deletion or addition of amino acids that have minimal influence on the immunogenicity, secondary structure and hydropathic nature of the polypeptide.

As noted above, polypeptides may comprise a signal (or leader) sequence at the N-terminal end of the protein, which co-translationally or post-translationally directs transfer of the protein. The polypeptide may also be conjugated to a linker or other sequence for ease of synthesis, purification or identification of the polypeptide (e.g., poly-His), or to enhance binding of the polypeptide to a solid support. For example, a polypeptide may be conjugated to an immunoglobulin Fc region.

When comparing polypeptide sequences, two sequences are said to be "identical" if the sequence of amino acids in the two sequences is the same when aligned for maximum correspondence, as described below. Comparisons between two sequences are typically performed by comparing the two sequences over a comparison window to identify and compare local regions of sequence similarity. A "comparison window" as used herein, refers to a segment of at least about 20 contiguous positions, usually 30 to about 75, 40 to about 50, in which a sequence may be compared to a reference sequence of the same number of contiguous positions after the two sequences are optimally aligned.

Optimal alignment of sequences for comparison may be conducted using the Megalign program in the Lasergene suite of bioinformatics software (DNASTAR, Inc., Madison, Wis.), using default parameters. This program embodies several alignment schemes described in the following references: Dayhoff, M. O. (1978) A model of evolutionary change in proteins—Matrices for detecting distant relationships. In Dayhoff, M. O. (ed.) Atlas of Protein Sequence and Structure, National Biomedical Research Foundation, Washington D.C. Vol. 5, Suppl. 3, pp. 345–358; Hein J. (1990) Unified Approach to Alignment and Phylogenes pp. 626–645 *Methods in Enzymology* vol. 183, Academic Press, Inc., San Diego, Calif.; Higgins, D. G. and Sharp, P. M. (1989) *CABIOS* 5:151–153; Myers, E. W. and Muller W. (1988) *CABIOS* 4:11–17; Robinson, E. D. (1971) *Comb. Theor* 11:105; Santou, N. Nes, M. (1987) *Mol. Biol. Evol.* 4:406–425; Sneath, P. H. A. and Sokal, R. R. (1973) *Numerical Taxonomy—the Principles and Practice of Numerical Taxonomy*, Freeman Press, San Francisco, Calif.; Wilbur, W. J. and Lipman, D. J. (1983) *Proc. Natl. Acad., Sci. USA* 80:726–730.

Alternatively, optimal alignment of sequences for comparison may be conducted by the local identity algorithm of Smith and Waterman (1981) *Add. APL. Math* 2:482, by the identity alignment algorithm of Needleman and Wunsch (1970) *J. Mol. Biol.* 48:443, by the search for similarity methods of Pearson and Lipman (1988) *Proc. Natl. Acad. Sci. USA* 85: 2444, by computerized implementations of these algorithms (GAP, BESTFIT, BLAST, FASTA, and TFASTA in the Wisconsin Genetics Software Package, Genetics Computer Group (GCG), 575 Science Dr., Madison, Wis.), or by inspection.

One preferred example of algorithms that are suitable for determining percent sequence identity and sequence similarity are the BLAST and BLAST 2.0 algorithms, which are described in Altschul et al. (1977) *Nucl. Acids Res.* 25:3389–3402 and Altschul et al. (1990) *J. Mol. Biol.* 215:403–410, respectively. BLAST and BLAST 2.0 can be used, for example with the parameters described herein, to determine percent sequence identity for the polynucleotides and polypeptides of the invention. Software for performing BLAST analyses is publicly available through the National Center for Biotechnology Information. For amino acid sequences, a scoring matrix can be used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T and X determine the sensitivity and speed of the alignment.

In one preferred approach, the "percentage of sequence identity" is determined by comparing two optimally aligned sequences over a window of comparison of at least 20 positions, wherein the portion of the polypeptide sequence in the comparison window may comprise additions or deletions (i.e., gaps) of 20 percent or less, usually 5 to 15 percent, or 10 to 12 percent, as compared to the reference sequences (which does not comprise additions or deletions) for optimal alignment of the two sequences. The percentage is calculated by determining the number of positions at which the identical amino acid residue occurs in both sequences to yield the number of matched positions, dividing the number of matched positions by the total number of positions in the reference sequence (i.e., the window size) and multiplying the results by 100 to yield the percentage of sequence identity.

Within other illustrative embodiments, a polypeptide may be a fusion polypeptide that comprises multiple polypeptides as described herein, or that comprises at least one polypeptide as described herein and an unrelated sequence, such as a known tumor protein. A fusion partner may, for example, assist in providing T helper epitopes (an immunological fusion partner), preferably T helper epitopes recognized by humans, or may assist in expressing the protein (an expression enhancer) at higher yields than the native recombinant protein. Certain preferred fusion partners are both immunological and expression enhancing fusion partners. Other fusion partners may be selected so as to increase the solubility of the polypeptide or to enable the polypeptide to be targeted to desired intracellular compartments. Still further fusion partners include affinity tags, which facilitate purification of the polypeptide.

Fusion polypeptides may generally be prepared using standard techniques, including chemical conjugation. Preferably, a fusion polypeptide is expressed as a recombinant polypeptide, allowing the production of increased levels, relative to a non-fused polypeptide, in an expression system. Briefly, DNA sequences encoding the polypeptide components may be assembled separately, and ligated into an appropriate expression vector. The 3' end of the DNA sequence encoding one polypeptide component is ligated, with or without a peptide linker, to the 5' end of a DNA sequence encoding the second polypeptide component so that the reading frames of the sequences are in phase. This permits translation into a single fusion polypeptide that retains the biological activity of both component polypeptides.

A peptide linker sequence may be employed to separate the first and second polypeptide components by a distance sufficient to ensure that each polypeptide folds into its secondary and tertiary structures. Such a peptide linker sequence is incorporated into the fusion polypeptide using standard techniques well known in the art. Suitable peptide linker sequences may be chosen based on the following factors: (1) their ability to adopt a flexible extended conformation; (2) their inability to adopt a secondary structure that could interact with functional epitopes on the first and second polypeptides; and (3) the lack of hydrophobic or charged residues that might react with the polypeptide functional epitopes. Preferred peptide linker sequences contain Gly, Asn and Ser residues. Other near neutral amino acids, such as Thr and Ala may also be used in the linker sequence. Amino acid sequences which may be usefully employed as linkers include those disclosed in Maratea et al., *Gene* 40:39–46, 1985; Murphy et al., *Proc. Natl. Acad. Sci. USA* 83:8258–8262, 1986; U.S. Pat. No. 4,935,233 and U.S. Pat. No. 4,751,180. The linker sequence may generally be from 1 to about 50 amino acids in length. Linker sequences are not required when the first and second polypeptides have non-essential N-terminal amino acid regions that can be used to separate the functional domains and prevent steric interference.

The ligated DNA sequences are operably linked to suitable transcriptional or translational regulatory elements. The regulatory elements responsible for expression of DNA are located only 5' to the DNA sequence encoding the first polypeptides. Similarly, stop codons required to end translation and transcription termination signals are only present 3' to the DNA sequence encoding the second polypeptide.

The fusion polypeptide can comprise a polypeptide as described herein together with an unrelated immunogenic protein, such as an immunogenic protein capable of eliciting a recall response. Examples of such proteins include tetanus, tuberculosis and hepatitis proteins (see, for example, Stoute et al. *New Engl. J. Med.*, 336:86–91, 1997).

In one preferred embodiment, the immunological fusion partner is derived from a Mycobacterium sp., such as *a Mycobacterium tuberculosis*-derived Ra12 fragment. Ra12 compositions and methods for their use in enhancing the expression and/or immunogenicity of heterologous polynucleotide/polypeptide sequences is described in U.S. patent application Ser. No. 60/158,585, the disclosure of which is incorporated herein by reference in its entirety. Briefly, Ra12 refers to a polynucleotide region that is a subsequence of a *Mycobacterium tuberculosis* MTB32A nucleic acid. MTB32A is a serine protease of 32 KD molecular weight encoded by a gene in virulent and avirulent strains of *M. tuberculosis*. The nucleotide sequence and amino acid sequence of MTB32A have been described (for example, U.S. patent application Ser. No. 60/158,585; see also, Skeiky et al., *Infection and Immun.* (1999) 67:3998–4007, incorporated herein by reference). C-terminal fragments of the MTB32A coding sequence express at high levels and remain as a soluble polypeptides throughout the purification process. Moreover, Ra12 may enhance the immunogenicity of heterologous immunogenic polypeptides with which it is fused. One preferred Ra12 fusion polypeptide comprises a 14 KD C-terminal fragment corresponding to amino acid residues 192 to 323 of MTB32A. Other preferred Ra12 polynucleotides generally comprise at least about 15 consecutive nucleotides, at least about 30 nucleotides, at least about 60 nucleotides, at least about 100 nucleotides, at least about 200 nucleotides, or at least about 300 nucleotides that encode a portion of a Ra12 polypeptide. Ra12 polynucleotides may comprise a native sequence (i.e., an endogenous sequence that encodes a Ra12 polypeptide or a portion thereof) or may comprise a variant of such a sequence. Ra12 polynucleotide variants may contain one or more substitutions, additions, deletions and/or insertions such that the biological activity of the encoded fusion polypeptide is not substantially diminished, relative to a fusion polypeptide comprising a native Ra12 polypeptide. Variants preferably exhibit at least about 70% identity, more preferably at least about 80% identity and most preferably at least about 90% identity to a polynucleotide sequence that encodes a native Ra12 polypeptide or a portion thereof.

Within other preferred embodiments, an immunological fusion partner is derived from protein D, a surface protein of the gram-negative bacterium Haemophilus influenza B (WO 91/18926). Preferably, a protein D derivative comprises approximately the first third of the protein (e.g., the first N-terminal 100–110 amino acids), and a protein D derivative may be lipidated. Within certain preferred embodiments, the first 109 residues of a Lipoprotein D fusion partner is included on the N-terminus to provide the polypeptide with additional exogenous T-cell epitopes and to increase the expression level in *E. coli* (thus functioning as an expression enhancer). The lipid tail ensures optimal presentation of the antigen to antigen presenting cells. Other fusion partners include the non-structural protein from influenzae virus, NS1 (hemaglutinin). Typically, the N-terminal 81 amino acids are used, although different fragments that include T-helper epitopes may be used.

In another embodiment, the immunological fusion partner is the protein known as LYTA, or a portion thereof (preferably a C-terminal portion). LYTA is derived from *Streptococcus pneumoniae*, which synthesizes an N-acetyl-L-alanine amidase known as amidase LYTA (encoded by the LytA gene; *Gene* 43:265–292, 1986). LYTA is an autolysin that specifically degrades certain bonds in the peptidoglycan backbone. The C-terminal domain of the LYTA protein is responsible for the affinity to the choline or to some choline analogues such as DEAE. This property has been exploited for the development of *E. coli* C-LYTA expressing plasmids useful for expression of fusion proteins. Purification of hybrid proteins containing the C-LYTA fragment at the amino terminus has been described (see *Biotechnology* 10:795–798, 1992). Within a preferred embodiment, a repeat portion of LYTA may be incorporated into a fusion polypeptide. A repeat portion is found in the C-terminal region starting at residue 178. A particularly preferred repeat portion incorporates residues 188–305.

Yet another illustrative embodiment involves fusion polypeptides, and the polynucleotides encoding them, wherein the fusion partner comprises a targeting signal capable of directing a polypeptide to the endosomal/lysosomal compartment, as described in U.S. Pat. No. 5,633,234. An immunogenic polypeptide of the invention, when fused with this targeting signal, will associate more efficiently with MHC class II molecules and thereby provide enhanced in vivo stimulation of $CD4^+$ T-cells specific for the polypeptide.

Polypeptides of the invention are prepared using any of a variety of well known synthetic and/or recombinant techniques, the latter of which are further described below. Polypeptides, portions and other variants generally less than about 150 amino acids can be generated by synthetic means, using techniques well known to those of ordinary skill in the art. In one illustrative example, such polypeptides are synthesized using any of the commercially available solid-phase techniques, such as the Merrifield solid-phase synthesis method, where amino acids are sequentially added to a growing amino acid chain. See Merrifield, *J. Am. Chem. Soc.* 85:2149–2146, 1963. Equipment for automated synthesis of polypeptides is commercially available from suppliers such as Perkin Elmer/Applied BioSystems Division (Foster City, Calif.), and may be operated according to the manufacturer's instructions.

In general, polypeptide compositions (including fusion polypeptides) of the invention are isolated. An "isolated" polypeptide is one that is removed from its original environment. For example, a naturally-occurring protein or polypeptide is isolated if it is separated from some or all of the coexisting materials in the natural system. Preferably, such polypeptides are also purified, e.g., are at least about 90% pure, more preferably at least about 95% pure and most preferably at least about 99% pure.

Polynucleotide Compositions

The present invention, in other aspects, provides polynucleotide compositions. The terms "DNA" and "polynucleotide" are used essentially interchangeably herein to refer to a DNA molecule that has been isolated free of total genomic DNA of a particular species. "Isolated," as used herein, means that a polynucleotide is substantially away from other coding sequences, and that the DNA molecule does not contain large portions of unrelated coding DNA, such as large chromosomal fragments or other functional genes or polypeptide coding regions. Of course, this refers to the DNA molecule as originally isolated, and does not exclude genes or coding regions later added to the segment by the hand of man.

As will be understood by those skilled in the art, the polynucleotide compositions of this invention can include genomic sequences, extra-genomic and plasmid-encoded sequences and smaller engineered gene segments that express, or may be adapted to express, proteins, polypeptides, peptides and the like. Such segments may be naturally isolated, or modified synthetically by the hand of man.

As will be also recognized by the skilled artisan, polynucleotides of the invention may be single-stranded (coding or antisense) or double-stranded, and may be DNA (genomic, cDNA or synthetic) or RNA molecules. RNA molecules may include HnRNA molecules, which contain introns and correspond to a DNA molecule in a one-to-one manner, and mRNA molecules, which do not contain introns. Additional coding or non-coding sequences may, but need not, be present within a polynucleotide of the present invention, and a polynucleotide may, but need not, be linked to other molecules and/or support materials.

Polynucleotides may comprise a native sequence (i.e., an endogenous sequence that encodes a polypeptide/protein of the invention or a portion thereof) or may comprise a sequence that encodes a variant or derivative, preferably an immunogenic variant or derivative, of such a sequence.

Therefore, according to another aspect of the present invention, polynucleotide compositions are provided that comprise some or all of a polynucleotide sequence set forth in any one of SEQ ID NOs: 1–111, 115–171, 173–175, 177, 179–305, 307–315, 326, 328, 330, 332–335, 340–375, 381, 382 and 384–476, 524, 526, 530, 531, 533, 535, 536, 552, 569–572, 587, 591, 593–606, 618–705, 709–774, 777, 789, 817, 823, 824, 878, 880–882 and 894, complements of a polynucleotide sequence set forth in any one of SEQ ID NOs: 1–111, 115–171, 173–175, 177, 179–305, 307–315, 326, 328, 330, 332–335, 340–375, 381, 382 and 384–476, 524, 526, 530, 531, 533, 535, 536, 552, 569–572, 587, 591, 593–606, 618–705, 709–774, 777, 789, 817, 823, 824, 878, 880–882 and 894, and degenerate variants of a polynucleotide sequence set forth in any one of SEQ ID NOs: 1–111, 115–171, 173–175, 177, 179–305, 307–315, 326, 328, 330, 332–335, 340–375, 381, 382 and 384–476, 524, 526, 530, 531, 533, 535, 536, 552, 569–572, 587, 591, 593–606, 618–705, 709–774, 777, 789, 817, 823, 824, 878, 880–882 and 894. In certain preferred embodiments, the polynucleotide sequences set forth herein encode immunogenic polypeptides, as described above.

In other related embodiments, the present invention provides polynucleotide variants having substantial identity to the sequences disclosed herein in SEQ ID NOs: 1–111, 115–171, 173–175, 177, 179–305, 307–315, 326, 328, 330, 332–335, 340–375, 381, 382 and 384–476, 524, 526, 530, 531, 533, 535, 536, 552, 569–572, 587, 591, 593–606, 618–705, 709–774, 777, 789, 817, 823, 824, 878, 880–882 and 894, for example those comprising at least 70% sequence identity, preferably at least 75%, 80%, 85%, 90%, 95%, 96%, 97%, 98%, or 99% or higher, sequence identity compared to a polynucleotide sequence of this invention using the methods described herein, (e.g., BLAST analysis using standard parameters, as described below). One skilled in this art will recognize that these values can be appropriately adjusted to determine corresponding identity of proteins encoded by two nucleotide sequences by taking into account codon degeneracy, amino acid similarity, reading frame positioning and the like.

Typically, polynucleotide variants will contain one or more substitutions, additions, deletions and/or insertions, preferably such that the immunogenicity of the polypeptide encoded by the variant polynucleotide is not substantially diminished relative to a polypeptide encoded by a polynucleotide sequence specifically set forth herein). The term "variants" should also be understood to encompasses homologous genes of xenogenic origin.

In additional embodiments, the present invention provides polynucleotide fragments comprising various lengths of contiguous stretches of sequence identical to, or complementary to, one or more of the sequences disclosed herein. For example, polynucleotides are provided by this invention that comprise at least about 10, 15, 20, 30, 40, 50, 75, 100, 150, 200, 300, 400, 500 or 1000 or more contiguous nucleotides of one or more of the sequences disclosed herein as well as all intermediate lengths there between. It will be readily understood that "intermediate lengths", in this context, means any length between the quoted values, such as 16, 17, 18, 19, etc.; 21, 22, 23, etc.; 30, 31, 32, etc.; 50, 51, 52, 53, etc.; 100, 101, 102, 103, etc.; 150, 151, 152, 153, etc.; including all integers through 200–500; 500–1,000, and the like.

In another embodiment of the invention, polynucleotide compositions are provided that are capable of hybridizing under moderate to high stringency conditions to a polynucleotide sequence provided herein, or a fragment thereof, or a complementary sequence thereof. Hybridization techniques are well known in the art of molecular biology. For purposes of illustration, suitable moderately stringent conditions for testing the hybridization of a polynucleotide of this invention with other polynucleotides include prewashing in a solution of 5×SSC, 0.5% SDS, 1.0 mM EDTA (pH 8.0); hybridizing at 50° C.–60° C., 5×SSC, overnight; followed by washing twice at 65° C. for 20 minutes with each of 2×, 0.5× and 0.2×SSC containing 0.1% SDS. One skilled in the art will understand that the stringency of hybridization can be readily manipulated, such as by altering the salt content of the hybridization solution and/or the temperature at which the hybridization is performed. For example, in another embodiment, suitable highly stringent hybridization conditions include those described above, with the exception that the temperature of hybridization is increased, e.g., to 60–65° C. or 65–70° C.

In certain preferred embodiments, the polynucleotides described above, e.g., polynucleotide variants, fragments and hybridizing sequences, encode polypeptides that are immunologically cross-reactive with a polypeptide sequence specifically set forth herein. In other preferred embodiments, such polynucleotides encode polypeptides that have a level of immunogenic activity of at least about 50%, preferably at least about 70%, and more preferably at least about 90% of that for a polypeptide sequence specifically set forth herein.

The polynucleotides of the present invention, or fragments thereof, regardless of the length of the coding sequence itself, may be combined with other DNA sequences, such as promoters, polyadenylation signals, additional restriction enzyme sites, multiple cloning sites, other coding segments, and the like, such that their overall length may vary considerably. It is therefore contemplated that a nucleic acid fragment of almost any length may be employed, with the total length preferably being limited by the ease of preparation and use in the intended recombinant DNA protocol. For example, illustrative polynucleotide segments with total lengths of about 10,000, about 5000, about 3000, about 2,000, about 1,000, about 500, about 200, about 100, about 50 base pairs in length, and the like, (including all intermediate lengths) are contemplated to be useful in many implementations of this invention.

When comparing polynucleotide sequences, two sequences are said to be "identical" if the sequence of nucleotides in the two sequences is the same when aligned for maximum correspondence, as described below. Comparisons between two sequences are typically performed by comparing the sequences over a comparison window to identify and compare local regions of sequence similarity. A "comparison window" as used herein, refers to a segment of at least about 20 contiguous positions, usually 30 to about 75, preferably 40 to about 50, in which a sequence may be compared to a reference sequence of the same number of contiguous positions after the two sequences are optimally aligned.

Optimal alignment of sequences for comparison may be conducted using the Megalign program in the Lasergene suite of bioinformatics software (DNASTAR, Inc., Madison, Wis.), using default parameters. This program embodies several alignment schemes described in the following references: Dayhoff, M. O. (1978) A model of evolutionary change in proteins—Matrices for detecting distant relationships. In Dayhoff, M. O. (ed.) Atlas of Protein Sequence and Structure, National Biomedical Research Foundation, Washington D.C. Vol. 5, Suppl. 3, pp. 345–358; Hein J. (1990) Unified Approach to Alignment and Phylogenes pp. 626–645 *Methods in Enzymology* vol. 183, Academic Press, Inc., San Diego, Calif.; Higgins, D. G. and Sharp, P. M. (1989) *CABIOS* 5:151–153; Myers, E. W. and Muller W. (1988) *CABIOS* 4:11–17; Robinson, E. D. (1971) *Comb. Theor* 11:105; Santou, N. Nes, M. (1987) *Mol. Biol. Evol.* 4:406–425; Sneath, P. H. A. and Sokal, R. R. (1973) *Numerical Taxonomy—the Principles and Practice of Numerical Taxonomy*, Freeman Press, San Francisco, Calif.; Wilbur, W. J. and Lipman, D. J. (1983) *Proc. Natl. Acad., Sci. USA* 80:726–730.

Alternatively, optimal alignment of sequences for comparison may be conducted by the local identity algorithm of Smith and Waterman (1981) *Add. APL. Math* 2:482, by the identity alignment algorithm of Needleman and Wunsch (1970) *J. Mol. Biol.* 48:443, by the search for similarity methods of Pearson and Lipman (1988) *Proc. Natl. Acad. Sci. USA* 85: 2444, by computerized implementations of these algorithms (GAP, BESTFIT, BLAST, FASTA, and TFASTA in the Wisconsin Genetics Software Package, Genetics Computer Group (GCG), 575 Science Dr., Madison, Wis.), or by inspection.

One preferred example of algorithms that are suitable for determining percent sequence identity and sequence similarity are the BLAST and BLAST 2.0 algorithms, which are described in Altschul et al. (1977) *Nucl. Acids Res.* 25:3389–3402 and Altschul et al. (1990) *J. Mol. Biol.* 215:403–410, respectively. BLAST and BLAST 2.0 can be used, for example with the parameters described herein, to determine percent sequence identity for the polynucleotides of the invention. Software for performing BLAST analyses is publicly available through the National Center for Biotechnology Information. In one illustrative example, cumulative scores can be calculated using, for nucleotide sequences, the parameters M (reward score for a pair of matching residues; always >0) and N (penalty score for mismatching residues; always <0). Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T and X determine the sensitivity and speed of the alignment. The BLASTN program (for nucleotide sequences) uses as defaults a wordlength (W) of 11, and expectation (E) of 10, and the BLOSUM62 scoring matrix (see Henikoff and Henikoff (1989) *Proc. Natl. Acad. Sci. USA* 89:10915) alignments, (B) of 50, expectation (E) of 10, M=5, N=−4 and a comparison of both strands.

Preferably, the "percentage of sequence identity" is determined by comparing two optimally aligned sequences over a window of comparison of at least 20 positions, wherein the portion of the polynucleotide sequence in the comparison window may comprise additions or deletions (i.e., gaps) of 20 percent or less, usually 5 to 15 percent, or 10 to 12 percent, as compared to the reference sequences (which does not comprise additions or deletions) for optimal alignment of the two sequences. The percentage is calculated by determining the number of positions at which the identical nucleic acid bases occurs in both sequences to yield the number of matched positions, dividing the number of matched positions by the total number of positions in the reference sequence (i.e., the window size) and multiplying the results by 100 to yield the percentage of sequence identity.

It will be appreciated by those of ordinary skill in the art that, as a result of the degeneracy of the genetic code, there are many nucleotide sequences that encode a polypeptide as described herein. Some of these polynucleotides bear minimal homology to the nucleotide sequence of any native gene. Nonetheless, polynucleotides that vary due to differences in codon usage are specifically contemplated by the present invention. Further, alleles of the genes comprising the polynucleotide sequences provided herein are within the scope of the present invention. Alleles are endogenous genes that are altered as a result of one or more mutations, such as deletions, additions and/or substitutions of nucleotides. The resulting mRNA and protein may, but need not, have an altered structure or function. Alleles may be identified using standard techniques (such as hybridization, amplification and/or database sequence comparison).

Therefore, in another embodiment of the invention, a mutagenesis approach, such as site-specific mutagenesis, is employed for the preparation of immunogenic variants and/or derivatives of the polypeptides described herein. By this approach, specific modifications in a polypeptide sequence can be made through mutagenesis of the underlying polynucleotides that encode them. These techniques provides a straightforward approach to prepare and test sequence variants, for example, incorporating one or more of the foregoing considerations, by introducing one or more nucleotide sequence changes into the polynucleotide.

Site-specific mutagenesis allows the production of mutants through the use of specific oligonucleotide sequences which encode the DNA sequence of the desired mutation, as well as a sufficient number of adjacent nucleotides, to provide a primer sequence of sufficient size and sequence complexity to form a stable duplex on both sides of the deletion junction being traversed. Mutations may be employed in a selected polynucleotide sequence to improve, alter, decrease, modify, or otherwise change the properties of the polynucleotide itself, and/or alter the properties, activity, composition, stability, or primary sequence of the encoded polypeptide.

In certain embodiments of the present invention, the inventors contemplate the mutagenesis of the disclosed polynucleotide sequences to alter one or more properties of the encoded polypeptide, such as the immunogenicity of a polypeptide vaccine. The techniques of site-specific mutagenesis are well-known in the art, and are widely used to create variants of both polypeptides and polynucleotides. For example, site-specific mutagenesis is often used to alter a specific portion of a DNA molecule. In such embodiments, a primer comprising typically about 14 to about 25 nucleotides or so in length is employed, with about 5 to about 10 residues on both sides of the junction of the sequence being altered.

As will be appreciated by those of skill in the art, site-specific mutagenesis techniques have often employed a phage vector that exists in both a single stranded and double stranded form. Typical vectors useful in site-directed mutagenesis include vectors such as the M13 phage. These phage are readily commercially-available and their use is generally well-known to those skilled in the art. Double-stranded plasmids are also routinely employed in site directed mutagenesis that eliminates the step of transferring the gene of interest from a plasmid to a phage.

In general, site-directed mutagenesis in accordance herewith is performed by first obtaining a single-stranded vector or melting apart of two strands of a double-stranded vector that includes within its sequence a DNA sequence that encodes the desired peptide. An oligonucleotide primer bearing the desired mutated sequence is prepared, generally synthetically. This primer is then annealed with the single-stranded vector, and subjected to DNA polymerizing enzymes such as *E. coli* polymerase I Klenow fragment, in order to complete the synthesis of the mutation-bearing strand. Thus, a heteroduplex is formed wherein one strand encodes the original non-mutated sequence and the second strand bears the desired mutation. This heteroduplex vector is then used to transform appropriate cells, such as *E. coli* cells, and clones are selected which include recombinant vectors bearing the mutated sequence arrangement.

The preparation of sequence variants of the selected peptide-encoding DNA segments using site-directed mutagenesis provides a means of producing potentially useful species and is not meant to be limiting as there are other ways in which sequence variants of peptides and the DNA sequences encoding them may be obtained. For example, recombinant vectors encoding the desired peptide sequence may be treated with mutagenic agents, such as hydroxylamine, to obtain sequence variants. Specific details regarding these methods and protocols are found in the teachings of Maloy et al., 1994; Segal, 1976; Prokop and Bajpai, 1991; Kuby, 1994; and Maniatis et al., 1982, each incorporated herein by reference, for that purpose.

As used herein, the term "oligonucleotide directed mutagenesis procedure" refers to template-dependent processes and vector-mediated propagation which result in an increase in the concentration of a specific nucleic acid molecule relative to its initial concentration, or in an increase in the concentration of a detectable signal, such as amplification. As used herein, the term "oligonucleotide directed mutagenesis procedure" is intended to refer to a process that involves the template-dependent extension of a primer molecule. The term template dependent process refers to nucleic acid synthesis of an RNA or a DNA molecule wherein the sequence of the newly synthesized strand of nucleic acid is dictated by the well-known rules of complementary base pairing (see, for example, Watson, 1987). Typically, vector mediated methodologies involve the introduction of the nucleic acid fragment into a DNA or RNA vector, the clonal amplification of the vector, and the recovery of the amplified nucleic acid fragment. Examples of such methodologies are provided by U.S. Pat. No. 4,237,224, specifically incorporated herein by reference in its entirety.

In another approach for the production of polypeptide variants of the present invention, recursive sequence recombination, as described in U.S. Pat. No. 5,837,458, may be employed. In this approach, iterative cycles of recombination and screening or selection are performed to "evolve" individual polynucleotide variants of the invention having, for example, enhanced immunogenic activity.

In other embodiments of the present invention, the polynucleotide sequences provided herein can be advantageously used as probes or primers for nucleic acid hybridization. As such, it is contemplated that nucleic acid segments that comprise a sequence region of at least about 15 contiguous nucleotides that has the same sequence as, or is complementary to, a 15 nucleotide long contiguous sequence disclosed herein will find particular utility. Longer contiguous identical or complementary sequences, e.g., those of about 20, 30, 40, 50, 100, 200, 500, 1000 (including all intermediate lengths) and even up to full length sequences will also be of use in certain embodiments.

The ability of such nucleic acid probes to specifically hybridize to a sequence of interest will enable them to be of use in detecting the presence of complementary sequences in a given sample. However, other uses are also envisioned, such as the use of the sequence information for the preparation of mutant species primers, or primers for use in preparing other genetic constructions.

Polynucleotide molecules having sequence regions consisting of contiguous nucleotide stretches of 10–14, 15–20, 30, 50, or even of 100–200 nucleotides or so (including intermediate lengths as well), identical or complementary to a polynucleotide sequence disclosed herein, are particularly contemplated as hybridization probes for use in, e.g., Southern and Northern blotting. This would allow a gene product, or fragment thereof, to be analyzed, both in diverse cell types and also in various bacterial cells. The total size of fragment, as well as the size of the complementary stretch(es), will ultimately depend on the intended use or application of the particular nucleic acid segment. Smaller fragments will generally find use in hybridization embodiments, wherein the length of the contiguous complementary region may be varied, such as between about 15 and about 100 nucleotides, but larger contiguous complementarity stretches may be used, according to the length complementary sequences one wishes to detect.

The use of a hybridization probe of about 15–25 nucleotides in length allows the formation of a duplex molecule that is both stable and selective. Molecules having contiguous complementary sequences over stretches greater than 15 bases in length are generally preferred, though, in order to increase stability and selectivity of the hybrid, and thereby improve the quality and degree of specific hybrid molecules obtained. One will generally prefer to design nucleic acid molecules having gene-complementary stretches of 15 to 25 contiguous nucleotides, or even longer where desired.

Hybridization probes may be selected from any portion of any of the sequences disclosed herein. All that is required is to review the sequences set forth herein, or to any continuous portion of the sequences, from about 15–25 nucleotides in length up to and including the full length sequence, that one wishes to utilize as a probe or primer. The choice of probe and primer sequences may be governed by various factors. For example, one may wish to employ primers from towards the termini of the total sequence.

Small polynucleotide segments or fragments may be readily prepared by, for example, directly synthesizing the fragment by chemical means, as is commonly practiced using an automated oligonucleotide synthesizer. Also, fragments may be obtained by application of nucleic acid reproduction technology, such as the PCR™ technology of U.S. Pat. No. 4,683,202 (incorporated herein by reference), by introducing selected sequences into recombinant vectors for recombinant production, and by other recombinant DNA techniques generally known to those of skill in the art of molecular biology.

The nucleotide sequences of the invention may be used for their ability to selectively form duplex molecules with complementary stretches of the entire gene or gene fragments of interest. Depending on the application envisioned, one will typically desire to employ varying conditions of hybridization to achieve varying degrees of selectivity of probe towards target sequence. For applications requiring high selectivity, one will typically desire to employ relatively stringent conditions to form the hybrids, e.g., one will select relatively low salt and/or high temperature conditions, such as provided by a salt concentration of from about 0.02 M to about 0.15 M salt at temperatures of from about 50° C. to about 70° C. Such selective conditions tolerate little, if any, mismatch between the probe and the template or target strand, and would be particularly suitable for isolating related sequences.

Of course, for some applications, for example, where one desires to prepare mutants employing a mutant primer strand hybridized to an underlying template, less stringent (reduced stringency) hybridization conditions will typically be needed in order to allow formation of the heteroduplex. In these circumstances, one may desire to employ salt conditions such as those of from about 0.15 M to about 0.9 M salt, at temperatures ranging from about 20° C. to about 55° C. Cross-hybridizing species can thereby be readily identified as positively hybridizing signals with respect to control hybridizations. In any case, it is generally appreciated that conditions can be rendered more stringent by the addition of increasing amounts of formamide, which serves to destabilize the hybrid duplex in the same manner as increased temperature. Thus, hybridization conditions can be readily manipulated, and thus will generally be a method of choice depending on the desired results.

According to another embodiment of the present invention, polynucleotide compositions comprising antisense oligonucleotides are provided. Antisense oligonucleotides have been demonstrated to be effective and targeted inhibitors of protein synthesis, and, consequently, provide a therapeutic approach by which a disease can be treated by inhibiting the synthesis of proteins that contribute to the disease. The efficacy of antisense oligonucleotides for inhibiting protein synthesis is well established. For example, the synthesis of polygalactauronase and the muscarine type 2 acetylcholine receptor are inhibited by antisense oligonucleotides directed to their respective mRNA sequences (U.S. Pat. No. 5,739,119 and U.S. Pat. No. 5,759,829). Further, examples of antisense inhibition have been demonstrated with the nuclear protein cyclin, the multiple drug resistance gene (MDG1), ICAM-1, E-selectin, STK-1, striatal $GABA_A$ receptor and human EGF (Jaskulski et al., Science. Jun, 10, 1988;240(4858):1544–6; Vasanthakumar and Ahmed, Cancer Commun. 1989;1(4):225–32; Peris et al., Brain Res Mol Brain Res. Jun. 15, 1998;57(2):310–20; U.S. Pat. No. 5,801, 154; U.S. Pat. No. 5,789,573; U.S. Pat. No. 5,718,709 and U.S. Pat. No. 5,610,288). Antisense constructs have also been described that inhibit and can be used to treat a variety of abnormal cellular proliferations, e.g. cancer (U.S. Pat. No. 5,747,470; U.S. Pat. No. 5,591,317 and U.S. Pat. No. 5,783,683).

Therefore, in certain embodiments, the present invention provides oligonucleotide sequences that comprise all, or a portion of, any sequence that is capable of specifically binding to polynucleotide sequence described herein, or a complement thereof. In one embodiment, the antisense oligonucleotides comprise DNA or derivatives thereof. In another embodiment, the oligonucleotides comprise RNA or derivatives thereof. In a third embodiment, the oligonucleotides are modified DNAs comprising a phosphorothioated modified backbone. In a fourth embodiment, the oligonucleotide sequences comprise peptide nucleic acids or derivatives thereof. In each case, preferred compositions comprise a sequence region that is complementary, and more preferably substantially-complementary, and even more preferably, completely complementary to one or more portions of polynucleotides disclosed herein. Selection of antisense compositions specific for a given gene sequence is based upon analysis of the chosen target sequence and determination of secondary structure, $T_m$, binding energy, and relative stability. Antisense compositions may be selected based upon their relative inability to form dimers, hairpins, or other secondary structures that would reduce or prohibit specific binding to the target mRNA in a host cell. Highly preferred target regions of the mRNA, are those which are at or near the AUG translation initiation codon, and those sequences which are substantially complementary to 5' regions of the mRNA. These secondary structure analyses and target site selection considerations can be performed, for example, using v.4 of the OLIGO primer analysis software and/or the BLASTN 2.0.5 algorithm software (Altschul et al., Nucleic Acids Res. Sep. 1, 1997;25(17):3389–402).

The use of an antisense delivery method employing a short peptide vector, termed MPG (27 residues), is also contemplated. The MPG peptide contains a hydrophobic domain derived from the fusion sequence of HIV gp41 and a hydrophilic domain from the nuclear localization sequence of SV40 T-antigen (Morris et al., Nucleic Acids Res. Jul. 15, 1997;25(14):2730–6). It has been demonstrated that several molecules of the MPG peptide coat the antisense oligonucleotides and can be delivered into cultured mammalian cells in less than 1 hour with relatively high efficiency (90%). Further, the interaction with MPG strongly increases both the stability of the oligonucleotide to nuclease and the ability to cross the plasma membrane.

According to another embodiment of the invention, the polynucleotide compositions described herein are used in the design and preparation of ribozyme molecules for inhibiting expression of the tumor polypeptides and proteins of the present invention in tumor cells. Ribozymes are RNA-protein complexes that cleave nucleic acids in a site-specific fashion. Ribozymes have specific catalytic domains that possess endonuclease activity (Kim and Cech, Proc Natl Acad Sci U S A. December 1987;84(24):8788–92; Forster and Symons, Cell. Apr. 24, 1987;49(2):211–20). For example, a large number of ribozymes accelerate phosphoester transfer reactions with a high degree of specificity, often cleaving only one of several phosphoesters in an oligonucleotide substrate (Cech et al., Cell. December 1981;27(3 Pt 2):487–96; Michel and Westhof, J Mol Biol. Dec. 5, 1990;216(3):585–610; Reinhold-Hurek and Shub, Nature. May 14, 1992;357(6374):173–6). This specificity has been attributed to the requirement that the substrate bind via specific base-pairing interactions to the internal guide sequence ("IGS") of the ribozyme prior to chemical reaction.

Six basic varieties of naturally-occurring enzymatic RNAs are known presently. Each can catalyze the hydrolysis of RNA phosphodiester bonds in trans (and thus can cleave other RNA molecules) under physiological conditions. In general, enzymatic nucleic acids act by first binding to a target RNA. Such binding occurs through the target binding portion of a enzymatic nucleic acid which is held in close proximity to an enzymatic portion of the molecule that acts to cleave the target RNA. Thus, the enzymatic nucleic acid first recognizes and then binds a target RNA through complementary base-pairing, and once bound to the correct site, acts enzymatically to cut the target RNA. Strategic cleavage of such a target RNA will destroy its ability to direct synthesis of an encoded protein. After an enzymatic nucleic acid has bound and cleaved its RNA target, it is released from that RNA to search for another target and can repeatedly bind and cleave new targets.

The enzymatic nature of a ribozyme is advantageous over many technologies, such as antisense technology (where a nucleic acid molecule simply binds to a nucleic acid target to block its translation) since the concentration of ribozyme necessary to affect a therapeutic treatment is lower than that of an antisense oligonucleotide. This advantage reflects the ability of the ribozyme to act enzymatically. Thus, a single ribozyme molecule is able to cleave many molecules of target RNA. In addition, the ribozyme is a highly specific inhibitor, with the specificity of inhibition depending not only on the base pairing mechanism of binding to the target RNA, but also on the mechanism of target RNA cleavage. Single mismatches, or base-substitutions, near the site of cleavage can completely eliminate catalytic activity of a ribozyme. Similar mismatches in antisense molecules do not prevent their action (Woolf et al., Proc Natl Acad Sci U S A. Aug. 15, 1992;89(16):7305–9). Thus, the specificity of action of a ribozyme is greater than that of an antisense oligonucleotide binding the same RNA site.

The enzymatic nucleic acid molecule may be formed in a hammerhead, hairpin, a hepatitis δ virus, group I intron or RNaseP RNA (in association with an RNA guide sequence) or Neurospora VS RNA motif. Examples of hammerhead motifs are described by Rossi et al. Nucleic Acids Res. Sep. 11, 1992;20(17):4559–65. Examples of hairpin motifs are described by Hampel et al. (Eur. Pat. Appl. Publ. No. EP 0360257), Hampel and Tritz, Biochemistry Jun. 13, 1989;28 (12):4929–33; Hampel et al., Nucleic Acids Res. Jan. 25, 1990;18(2):299–304 and U.S. Pat. No. 5,631,359. An example of the hepatitis δ virus motif is described by Perrotta and Been, Biochemistry. Dec. 1, 1992;31(47):11843–52; an example of the RNaseP motif is described by Guerrier-Takada et al., Cell. December 1983;35(3 Pt 2):849–57; Neurospora VS RNA ribozyme motif is described by Collins (Saville and Collins, Cell. May 18, 1990;61(4):685–96; Saville and Collins, Proc Natl Acad Sci U S A. Oct. 1, 1991;88(19):8826–30; Collins and Olive, Biochemistry. Mar. 23, 1993;32(11):2795–9); and an example of the Group I intron is described in (U.S. Pat. No. 4,987,071). All that is important in an enzymatic nucleic acid molecule of this invention is that it has a specific substrate binding site which is complementary to one or more of the target gene RNA regions, and that it have nucleotide sequences within or surrounding that substrate binding site which impart an RNA cleaving activity to the molecule. Thus the ribozyme constructs need not be limited to specific motifs mentioned herein.

Ribozymes may be designed as described in Int. Pat. Appl. Publ. No. WO 93/23569 and Int. Pat. Appl. Publ. No. WO 94/02595, each specifically incorporated herein by reference) and synthesized to be tested in vitro and in vivo, as described. Such ribozymes can also be optimized for delivery. While specific examples are provided, those in the art will recognize that equivalent RNA targets in other species can be utilized when necessary.

Ribozyme activity can be optimized by altering the length of the ribozyme binding arms, or chemically synthesizing ribozymes with modifications that prevent their degradation by serum ribonucleases (see e.g., Int. Pat. Appl. Publ. No. WO 92/07065; Int. Pat. Appl. Publ. No. WO 93/15187; Int. Pat. Appl. Publ. No. WO 91/03162; Eur. Pat. Appl. Publ. No. 92110298.4; U.S. Pat. No. 5,334,711; and Int. Pat. Appl. Publ. No. WO 94/13688, which describe various chemical modifications that can be made to the sugar moieties of enzymatic RNA molecules), modifications which enhance their efficacy in cells, and removal of stem II bases to shorten RNA synthesis times and reduce chemical requirements.

Sullivan et al. (Int. Pat. Appl. Publ. No. WO 94/02595) describes the general methods for delivery of enzymatic RNA molecules. Ribozymes may be administered to cells by a variety of methods known to those familiar to the art, including, but not restricted to, encapsulation in liposomes, by iontophoresis, or by incorporation into other vehicles, such as hydrogels, cyclodextrins, biodegradable nanocapsules, and bioadhesive microspheres. For some indications, ribozymes may be directly delivered ex vivo to cells or tissues with or without the aforementioned vehicles. Alternatively, the RNA/vehicle combination may be locally delivered by direct inhalation, by direct injection or by use of a catheter, infusion pump or stent. Other routes of delivery include, but are not limited to, intravascular, intramuscular, subcutaneous or joint injection, aerosol inhalation, oral (tablet or pill form), topical, systemic, ocular, intraperitoneal and/or intrathecal delivery. More detailed descriptions of ribozyme delivery and administration are provided in Int. Pat. Appl. Publ. No. WO 94/02595 and Int. Pat. Appl. Publ. No. WO 93/23569, each specifically incorporated herein by reference.

Another means of accumulating high concentrations of a ribozyme(s) within cells is to incorporate the ribozyme-encoding sequences into a DNA expression vector. Transcription of the ribozyme sequences are driven from a promoter for eukaryotic RNA polymerase I (pol I), RNA polymerase II (pol II), or RNA polymerase III (pol III). Transcripts from pol II or pol III promoters will be expressed at high levels in all cells; the levels of a given pol II promoter in a given cell type will depend on the nature of the gene regulatory sequences (enhancers, silencers, etc.) present nearby. Prokaryotic RNA polymerase promoters may also be used, providing that the prokaryotic RNA polymerase enzyme is expressed in the appropriate cells Ribozymes expressed from such promoters have been shown to function in mammalian cells. Such transcription units can be incorporated into a variety of vectors for introduction into mammalian cells, including but not restricted to, plasmid DNA vectors, viral DNA vectors (such as adenovirus or adeno-associated vectors), or viral RNA vectors (such as retroviral, semliki forest virus, sindbis virus vectors).

In another embodiment of the invention, peptide nucleic acids (PNAs) compositions are provided. PNA is a DNA mimic in which the nucleobases are attached to a pseudopeptide backbone (Good and Nielsen, Antisense Nucleic Acid Drug Dev. 1997 7(4) 431–37). PNA is able to be utilized in a number methods that traditionally have used RNA or DNA. Often PNA sequences perform better in techniques than the corresponding RNA or DNA sequences and have utilities that are not inherent to RNA or DNA. A review of PNA including methods of making, characteristics of, and methods of using, is provided by Corey (*Trends Biotechnol June* 1997;15(6):224–9). As such, in certain embodiments, one may prepare PNA sequences that are complementary to one or more portions of the ACE mRNA sequence, and such PNA compositions may be used to regulate, alter, decrease, or reduce the translation of ACE-specific mRNA, and thereby alter the level of ACE activity in a host cell to which such PNA compositions have been administered.

PNAs have 2-aminoethyl-glycine linkages replacing the normal phosphodiester backbone of DNA (Nielsen et al., *Science Dec.* 6, 1991;254(5037):1497–500; Hanvey et al., Science. Nov. 27, 1992;258(5087):1481–5; Hyrup and Nielsen, Bioorg Med Chem. January 1996;4(1):5–23). This chemistry has three important consequences: firstly, in contrast to DNA or phosphorothioate oligonucleotides, PNAs are neutral molecules; secondly, PNAs are achiral, which avoids the need to develop a stereoselective synthesis; and thirdly, PNA synthesis uses standard Boc or Fmoc protocols for solid-phase peptide synthesis, although other methods, including a modified Merrifield method, have been used.

PNA monomers or ready-made oligomers are commercially available from PerSeptive Biosystems (Framingham, MA). PNA syntheses by either Boc or Fmoc protocols are straightforward using manual or automated protocols (Norton et al., Bioorg Med Chem. April 1995;3(4):437–45). The manual protocol lends itself to the production of chemically modified PNAs or the simultaneous synthesis of families of closely related PNAs.

As with peptide synthesis, the success of a particular PNA synthesis will depend on the properties of the chosen sequence. For example, while in theory PNAs can incorporate any combination of nucleotide bases, the presence of adjacent purines can lead to deletions of one or more residues in the product. In expectation of this difficulty, it is suggested that, in producing PNAs with adjacent purines, one should repeat the coupling of residues likely to be added inefficiently. This should be followed by the purification of PNAs by reverse-phase high-pressure liquid chromatography, providing yields and purity of product similar to those observed during the synthesis of peptides.

Modifications of PNAs for a given application may be accomplished by coupling amino acids during solid-phase synthesis or by attaching compounds that contain a carboxylic acid group to the exposed N-terminal amine. Alternatively, PNAs can be modified after synthesis by coupling to an introduced lysine or cysteine. The ease with which PNAs can be modified facilitates optimization for better solubility or for specific functional requirements. Once synthesized, the identity of PNAs and their derivatives can be confirmed by mass spectrometry. Several studies have made and utilized modifications of PNAs (for example, Norton et al., Bioorg Med Chem. April 1995;3(4):437–45; Petersen et al., J Pept Sci. May–June 1995;1(3):175–83; Orum et al., Biotechniques. September 1995;19(3):472–80; Footer et al., Biochemistry. Aug. 20, 1996;35(33):10673–9; Griffith et al., Nucleic Acids Res. Aug. 11, 1995;23(15):3003–8; Pardridge et al., Proc Natl Acad Sci U S A. Jun. 6, 1995;92(12):5592–6; Boffa et al., Proc Natl Acad Sci U S A. Mar. 14, 1995;92(6):1901–5; Gambacorti-Passerini et al., Blood. Aug. 15, 1996;88(4):1411–7; Armitage et al., Proc Natl Acad Sci U S A. Nov. 11, 1997;94(23):12320–5; Seeger et al., Biotechniques. September 1997;23(3):512–7). U.S. Pat. No. 5,700,922 discusses PNA-DNA-PNA chimeric molecules and their uses in diagnostics, modulating protein in organisms, and treatment of conditions susceptible to therapeutics.

Methods of characterizing the antisense binding properties of PNAs are discussed in Rose (Anal Chem. Dec. 15, 1993;65(24):3545–9) and Jensen et al. (Biochemistry. Apr. 22, 1997;36(16):5072–7). Rose uses capillary gel electrophoresis to determine binding of PNAs to their complementary oligonucleotide, measuring the relative binding kinetics and stoichiometry. Similar types of measurements were made by Jensen et al. using BIAcore™ technology.

Other applications of PNAs that have been described and will be apparent to the skilled artisan include use in DNA strand invasion, antisense inhibition, mutational analysis, enhancers of transcription, nucleic acid purification, isolation of transcriptionally active genes, blocking of transcription factor binding, genome cleavage, biosensors, in situ hybridization, and the like.

Polynucleotide Identification, Characterization and Expression

Polynucleotide compositions of the present invention may be identified, prepared and/or manipulated using any of a variety of well established techniques (see generally, Sambrook et al., *Molecular Cloning: A Laboratory Manual*, Cold Spring Harbor Laboratories, Cold Spring Harbor, N.Y., 1989, and other like references). For example, a polynucleotide may be identified, as described in more detail below, by screening a microarray of cDNAs for tumor-associated expression (i.e., expression that is at least two fold greater in a tumor than in normal tissue, as determined using a representative assay provided herein). Such screens may be performed, for example, using the microarray technology of Affymetrix, Inc. (Santa Clara, Calif.) according to the manufacturer's instructions (and essentially as described by Schena et al., *Proc. Natl. Acad. Sci. USA* 93:10614–10619, 1996 and Heller et al., *Proc. Natl. Acad. Sci. USA* 94:2150–2155, 1997). Alternatively, polynucleotides may be amplified from cDNA prepared from cells expressing the proteins described herein, such as tumor cells.

Many template dependent processes are available to amplify a target sequences of interest present in a sample. One of the best known amplification methods is the polymerase chain reaction (PCR™) which is described in detail in U.S. Pat. Nos. 4,683,195, 4,683,202 and 4,800,159, each of which is incorporated herein by reference in its entirety. Briefly, in PCR™, two primer sequences are prepared which are complementary to regions on opposite complementary strands of the target sequence. An excess of deoxynucleoside triphosphates is added to a reaction mixture along with a DNA polymerase (e.g., Taq polymerase). If the target sequence is present in a sample, the primers will bind to the target and the polymerase will cause the primers to be extended along the target sequence by adding on nucleotides. By raising and lowering the temperature of the reaction mixture, the extended primers will dissociate from the target to form reaction products, excess primers will bind to the target and to the reaction product and the process is repeated. Preferably reverse transcription and PCR™ amplification procedure may be performed in order to quantify the amount of mRNA amplified. Polymerase chain reaction methodologies are well known in the art.

Any of a number of other template dependent processes, many of which are variations of the PCR™ amplification technique, are readily known and available in the art. Illustratively, some such methods include the ligase chain reaction (referred to as LCR), described, for example, in Eur. Pat. Appl. Publ. No. 320,308 and U.S. Pat. No. 4,883,750; Qbeta Replicase, described in PCT Intl. Pat. Appl. Publ. No. PCT/US87/00880; Strand Displacement Amplification (SDA) and Repair Chain Reaction (RCR). Still other amplification methods are described in Great Britain Pat. Appl. No. 2 202 328, and in PCT Intl. Pat. Appl. Publ. No. PCT/US89/01025. Other nucleic acid amplification procedures include transcription-based amplification systems (TAS) (PCT Intl. Pat. Appl. Publ. No. WO 88/10315), including nucleic acid sequence based amplification (NASBA) and 3SR. Eur. Pat. Appl. Publ. No. 329,822 describes a nucleic acid amplification process involving cyclically synthesizing single-stranded RNA ("ssRNA"), ssDNA, and double-stranded DNA (dsDNA). PCT Intl. Pat. Appl. Publ. No. WO 89/06700 describes a nucleic acid sequence amplification scheme based on the hybridization of a promoter/primer sequence to a target single-stranded DNA ("ssDNA") followed by transcription of many RNA copies of the sequence. Other amplification methods such as "RACE" (Frohman, 1990), and "one-sided PCR" (Ohara, 1989) are also well-known to those of skill in the art.

An amplified portion of a polynucleotide of the present invention may be used to isolate a full length gene from a suitable library (e.g., a tumor cDNA library) using well known techniques. Within such techniques, a library (cDNA or genomic) is screened using one or more polynucleotide probes or primers suitable for amplification. Preferably, a library is size-selected to include larger molecules. Random primed libraries may also be preferred for identifying 5' and upstream regions of genes. Genomic libraries are preferred for obtaining introns and extending 5' sequences.

For hybridization techniques, a partial sequence may be labeled (e.g., by nick-translation or end-labeling with $^{32}P$) using well known techniques. A bacterial or bacteriophage library is then generally screened by hybridizing filters containing denatured bacterial colonies (or lawns containing phage plaques) with the labeled probe (see Sambrook et al., *Molecular Cloning: A Laboratory Manual*, Cold Spring Harbor Laboratories, Cold Spring Harbor, N.Y., 1989). Hybridizing colonies or plaques are selected and expanded, and the DNA is isolated for further analysis. cDNA clones may be analyzed to determine the amount of additional sequence by, for example, PCR using a primer from the partial sequence and a primer from the vector. Restriction maps and partial sequences may be generated to identify one or more overlapping clones. The complete sequence may then be determined using standard techniques, which may involve generating a series of deletion clones. The resulting overlapping sequences can then assembled into a single contiguous sequence. A full length cDNA molecule can be generated by ligating suitable fragments, using well known techniques.

Alternatively, amplification techniques, such as those described above, can be useful for obtaining a full length coding sequence from a partial cDNA sequence. One such amplification technique is inverse PCR (see Triglia et al., *Nucl. Acids Res.* 16:8186, 1988), which uses restriction enzymes to generate a fragment in the known region of the gene. The fragment is then circularized by intramolecular ligation and used as a template for PCR with divergent primers derived from the known region. Within an alternative approach, sequences adjacent to a partial sequence may be retrieved by amplification with a primer to a linker sequence and a primer specific to a known region. The amplified sequences are typically subjected to a second round of amplification with the same linker primer and a second primer specific to the known region. A variation on this procedure, which employs two primers that initiate extension in opposite directions from the known sequence, is described in WO 96/38591. Another such technique is known as "rapid amplification of cDNA ends" or RACE. This technique involves the use of an internal primer and an external primer, which hybridizes to a polyA region or vector sequence, to identify sequences that are 5' and 3' of a known sequence. Additional techniques include capture PCR (Lagerstrom et al., PCR Methods Applic. 1:111–19, 1991) and walking PCR (Parker et al., Nucl. Acids. Res. 19:3055–60, 1991). Other methods employing amplification may also be employed to obtain a full length cDNA sequence.

In certain instances, it is possible to obtain a full length cDNA sequence by analysis of sequences provided in an expressed sequence tag (EST) database, such as that available from GenBank. Searches for overlapping ESTs may generally be performed using well known programs (e.g., NCBI BLAST searches), and such ESTs may be used to generate a contiguous full length sequence. Full length DNA sequences may also be obtained by analysis of genomic fragments.

In other embodiments of the invention, polynucleotide sequences or fragments thereof which encode polypeptides of the invention, or fusion proteins or functional equivalents thereof, may be used in recombinant DNA molecules to direct expression of a polypeptide in appropriate host cells. Due to the inherent degeneracy of the genetic code, other DNA sequences that encode substantially the same or a functionally equivalent amino acid sequence may be produced and these sequences may be used to clone and express a given polypeptide.

As will be understood by those of skill in the art, it may be advantageous in some instances to produce polypeptide-encoding nucleotide sequences possessing non-naturally occurring codons. For example, codons preferred by a particular prokaryotic or eukaryotic host can be selected to increase the rate of protein expression or to produce a recombinant RNA transcript having desirable properties, such as a half-life which is longer than that of a transcript generated from the naturally occurring sequence.

Moreover, the polynucleotide sequences of the present invention can be engineered using methods generally known in the art in order to alter polypeptide encoding sequences for a variety of reasons, including but not limited to, alterations which modify the cloning, processing, and/or expression of the gene product. For example, DNA shuffling by random fragmentation and PCR reassembly of gene fragments and synthetic oligonucleotides may be used to engineer the nucleotide sequences. In addition, site-directed mutagenesis may be used to insert new restriction sites, alter glycosylation patterns, change codon preference, produce splice variants, or introduce mutations, and so forth.

In another embodiment of the invention, natural, modified, or recombinant nucleic acid sequences may be ligated to a heterologous sequence to encode a fusion protein. For example, to screen peptide libraries for inhibitors of polypeptide activity, it may be useful to encode a chimeric protein that can be recognized by a commercially available antibody. A fusion protein may also be engineered to contain a cleavage site located between the polypeptide-encoding sequence and the heterologous protein sequence, so that the polypeptide may be cleaved and purified away from the heterologous moiety.

Sequences encoding a desired polypeptide may be synthesized, in whole or in part, using chemical methods well known in the art (see Caruthers, M. H. et al. (1980) Nucl. Acids Res. Symp. Ser. 215–223, Horn, T. et al. (1980) Nucl. Acids Res. Symp. Ser. 225–232). Alternatively, the protein itself may be produced using chemical methods to synthesize the amino acid sequence of a polypeptide, or a portion thereof. For example, peptide synthesis can be performed using various solid-phase techniques (Roberge, J. Y. et al. (1995) Science 269:202–204) and automated synthesis may be achieved, for example, using the ABI 431A Peptide Synthesizer (Perkin Elmer, Palo Alto, Calif.).

A newly synthesized peptide may be substantially purified by preparative high performance liquid chromatography (e.g., Creighton, T. (1983) Proteins, Structures and Molecular Principles, WH Freeman and Co., New York, N.Y.) or other comparable techniques available in the art. The composition of the synthetic peptides may be confirmed by amino acid analysis or sequencing (e.g., the Edman degradation procedure). Additionally, the amino acid sequence of a polypeptide, or any part thereof, may be altered during direct synthesis and/or combined using chemical methods with sequences from other proteins, or any part thereof, to produce a variant polypeptide.

In order to express a desired polypeptide, the nucleotide sequences encoding the polypeptide, or functional equivalents, may be inserted into appropriate expression vector, i.e., a vector which contains the necessary elements for the transcription and translation of the inserted coding sequence. Methods which are well known to those skilled in the art may be used to construct expression vectors containing sequences encoding a polypeptide of interest and appropriate transcriptional and translational control elements. These methods include in vitro recombinant DNA techniques, synthetic techniques, and in vivo genetic recombination. Such techniques are described, for example, in Sambrook, J. et al. (1989) Molecular Cloning, A Laboratory Manual, Cold Spring Harbor Press, Plainview, N.Y., and Ausubel, F. M. et al. (1989) Current Protocols in Molecular Biology, John Wiley & Sons, New York. N.Y.

A variety of expression vector/host systems may be utilized to contain and express polynucleotide sequences. These include, but are not limited to, microorganisms such as bacteria transformed with recombinant bacteriophage, plasmid, or cosmid DNA expression vectors; yeast transformed with yeast expression vectors; insect cell systems infected with virus expression vectors (e.g., baculovirus); plant cell systems transformed with virus expression vectors (e.g., cauliflower mosaic virus, CaMV; tobacco mosaic virus, TMV) or with bacterial expression vectors (e.g., Ti or pBR322 plasmids); or animal cell systems.

The "control elements" or "regulatory sequences" present in an expression vector are those non-translated regions of the vector—enhancers, promoters, 5' and 3' untranslated regions—which interact with host cellular proteins to carry out transcription and translation. Such elements may vary in their strength and specificity. Depending on the vector system and host utilized, any number of suitable transcription and translation elements, including constitutive and inducible promoters, may be used. For example, when cloning in bacterial systems, inducible promoters such as the hybrid lacZ promoter of the PBLUESCRIPT phagemid (Stratagene, La Jolla, Calif.) or PSPORT1 plasmid (Gibco BRL, Gaithersburg, Md.) and the like may be used. In mammalian cell systems, promoters from mammalian genes or from mammalian viruses are generally preferred. If it is necessary to generate a cell line that contains multiple copies of the sequence encoding a polypeptide, vectors based on SV40 or EBV may be advantageously used with an appropriate selectable marker.

In bacterial systems, any of a number of expression vectors may be selected depending upon the use intended for the expressed polypeptide. For example, when large quantities are needed, for example for the induction of antibodies, vectors which direct high level expression of fusion proteins that are readily purified may be used. Such vectors include, but are not limited to, the multifunctional E. coli cloning and expression vectors such as BLUESCRIPT (Stratagene), in which the sequence encoding the polypeptide of interest may be ligated into the vector in frame with sequences for the amino-terminal Met and the subsequent 7 residues of .beta.-galactosidase so that a hybrid protein is produced; pIN vectors (Van Heeke, G. and S. M. Schuster (1989) J. Biol. Chem. 264:5503–5509); and the like. pGEX Vectors (Promega, Madison, Wis.) may also be used to express foreign polypeptides as fusion proteins with glutathione S-transferase (GST). In general, such fusion proteins are soluble and can easily be purified from lysed cells by adsorption to glutathione-agarose beads followed by elution in the presence of free glutathione. Proteins made in such systems may be designed to include heparin, thrombin, or factor XA protease cleavage sites so that the cloned polypeptide of interest can be released from the GST moiety at will.

In the yeast, Saccharomyces cerevisiae, a number of vectors containing constitutive or inducible promoters such as alpha factor, alcohol oxidase, and PGH may be used. For reviews, see Ausubel et al. (supra) and Grant et al. (1987) Methods Enzymol. 153:516–544.

In cases where plant expression vectors are used, the expression of sequences encoding polypeptides may be driven by any of a number of promoters. For example, viral promoters such as the 35S and 19S promoters of CaMV may be used alone or in combination with the omega leader sequence from TMV (Takamatsu, N. (1987) EMBO J. 6:307–311. Alternatively, plant promoters such as the small subunit of RUBISCO or heat shock promoters may be used (Coruzzi, G. et al. (1984) EMBO J. 3:1671–1680; Broglie, R. et al. (1984) Science 224:838–843; and Winter, J. et al. (1991) Results Probl. Cell Differ. 17:85–105). These constructs can be introduced into plant cells by direct DNA transformation or pathogen-mediated transfection. Such techniques are described in a number of generally available reviews (see, for example, Hobbs, S. or Murry, L. E. in McGraw Hill Yearbook of Science and Technology (1992) McGraw Hill, New York, N.Y.; pp. 191–196).

An insect system may also be used to express a polypeptide of interest. For example, in one such system, Autographa californica nuclear polyhedrosis virus (AcNPV) is used as a vector to express foreign genes in Spodoptera frugiperda cells or in Trichoplusia larvae. The sequences encoding the polypeptide may be cloned into a non-essential region of the virus, such as the polyhedrin gene, and placed under control of the polyhedrin promoter. Successful insertion of the polypeptide-encoding sequence will render the polyhedrin gene inactive and produce recombinant virus lacking coat protein. The recombinant viruses may then be used to infect, for example, S. frugiperda cells or Trichoplusia larvae in which the polypeptide of interest may be expressed (Engelhard, E. K. et al. (1994) Proc. Natl. Acad. Sci. 91 :3224–3227).

In mammalian host cells, a number of viral-based expression systems are generally available. For example, in cases where an adenovirus is used as an expression vector, sequences encoding a polypeptide of interest may be ligated into an adenovirus transcription/translation complex consisting of the late promoter and tripartite leader sequence. Insertion in a non-essential E1 or E3 region of the viral genome may be used to obtain a viable virus which is capable of expressing the polypeptide in infected host cells (Logan, J. and Shenk, T. (1984) Proc. Natl. Acad. Sci. 81:3655–3659). In addition, transcription enhancers, such as the Rous sarcoma virus (RSV) enhancer, may be used to increase expression in mammalian host cells.

Specific initiation signals may also be used to achieve more efficient translation of sequences encoding a polypeptide of interest. Such signals include the ATG initiation codon and adjacent sequences. In cases where sequences encoding the polypeptide, its initiation codon, and upstream sequences are inserted into the appropriate expression vector, no additional transcriptional or translational control signals may be needed. However, in cases where only coding sequence, or a portion thereof, is inserted, exogenous translational control signals including the ATG initiation codon should be provided. Furthermore, the initiation codon should be in the correct reading frame to ensure translation of the entire insert. Exogenous translational elements and initiation codons may be of various origins, both natural and synthetic. The efficiency of expression may be enhanced by the inclusion of enhancers which are appropriate for the particular cell system which is used, such as those described in the literature (Scharf, D. et al. (1994) Results Probl. Cell Differ. 20:125–162).

In addition, a host cell strain may be chosen for its ability to modulate the expression of the inserted sequences or to process the expressed protein in the desired fashion. Such modifications of the polypeptide include, but are not limited to, acetylation, carboxylation, glycosylation, phosphorylation, lipidation, and acylation. Post-translational processing which cleaves a "prepro" form of the protein may also be used to facilitate correct insertion, folding and/or function. Different host cells such as CHO, COS, HeLa, MDCK, HEK293, and WI38, which have specific cellular machinery and characteristic mechanisms for such post-translational activities, may be chosen to ensure the correct modification and processing of the foreign protein.

For long-term, high-yield production of recombinant proteins, stable expression is generally preferred. For example, cell lines which stably express a polynucleotide of interest may be transformed using expression vectors which may contain viral origins of replication and/or endogenous expression elements and a selectable marker gene on the same or on a separate vector. Following the introduction of the vector, cells may be allowed to grow for 1–2 days in an enriched media before they are switched to selective media. The purpose of the selectable marker is to confer resistance to selection, and its presence allows growth and recovery of cells which successfully express the introduced sequences. Resistant clones of stably transformed cells may be proliferated using tissue culture techniques appropriate to the cell type.

Any number of selection systems may be used to recover transformed cell lines. These include, but are not limited to, the herpes simplex virus thymidine kinase (Wigler, M. et al. (1977) Cell 11:223–32) and adenine phosphoribosyltransferase (Lowy, I. et al. (1990) Cell 22:817–23) genes which can be employed in tk.sup.- or aprt.sup.- cells, respectively. Also, antimetabolite, antibiotic or herbicide resistance can be used as the basis for selection; for example, dhfr which confers resistance to methotrexate (Wigler, M. et al. (1980) Proc. Natl. Acad. Sci. 77:3567–70); npt, which confers resistance to the aminoglycosides, neomycin and G-418 (Colbere-Garapin, F. et al (1981) J. Mol. Biol. 150:1–14); and als or pat, which confer resistance to chlorsulfuron and phosphinotricin acetyltransferase, respectively (Murry, supra). Additional selectable genes have been described, for example, trpB, which allows cells to utilize indole in place of tryptophan, or hisD, which allows cells to utilize histinol in place of histidine (Hartman, S. C. and R. C. Mulligan (1988) *Proc. Natl. Acad. Sci.* 85:8047–51). The use of visible markers has gained popularity with such markers as anthocyanins, beta-glucuronidase and its substrate GUS, and luciferase and its substrate luciferin, being widely used not only to identify transformants, but also to quantify the amount of transient or stable protein expression attributable to a specific vector system (Rhodes, C. A. et al. (1995) *Methods Mol. Biol.* 55:121–131).

Although the presence/absence of marker gene expression suggests that the gene of interest is also present, its presence and expression may need to be confirmed. For example, if the sequence encoding a polypeptide is inserted within a marker gene sequence, recombinant cells containing sequences can be identified by the absence of marker gene function. Alternatively, a marker gene can be placed in tandem with a polypeptide-encoding sequence under the control of a single promoter. Expression of the marker gene in response to induction or selection usually indicates expression of the tandem gene as well.

Alternatively, host cells that contain and express a desired polynucleotide sequence may be identified by a variety of procedures known to those of skill in the art. These procedures include, but are not limited to, DNA-DNA or DNA-RNA hybridizations and protein bioassay or immunoassay techniques which include, for example, membrane, solution, or chip based technologies for the detection and/or quantification of nucleic acid or protein.

A variety of protocols for detecting and measuring the expression of polynucleotide-encoded products, using either polyclonal or monoclonal antibodies specific for the product are known in the art. Examples include enzyme-linked immunosorbent assay (ELISA), radioimmunoassay (RIA), and fluorescence activated cell sorting (FACS). A two-site, monoclonal-based immunoassay utilizing monoclonal antibodies reactive to two non-interfering epitopes on a given polypeptide may be preferred for some applications, but a competitive binding assay may also be employed. These and other assays are described, among other places, in Hampton, R. et al. (1990; Serological Methods, a Laboratory Manual, APS Press, St Paul. Minn.) and Maddox, D. E. et al. (1983; *J. Exp. Med.* 158:1211–1216).

A wide variety of labels and conjugation techniques are known by those skilled in the art and may be used in various nucleic acid and amino acid assays. Means for producing labeled hybridization or PCR probes for detecting sequences related to polynucleotides include oligolabeling, nick translation, end-labeling or PCR amplification using a labeled nucleotide. Alternatively, the sequences, or any portions thereof may be cloned into a vector for the production of an mRNA probe. Such vectors are known in the art, are commercially available, and may be used to synthesize RNA probes in vitro by addition of an appropriate RNA polymerase such as T7, T3, or SP6 and labeled nucleotides. These procedures may be conducted using a variety of commercially available kits. Suitable reporter molecules or labels, which may be used include radionuclides, enzymes, fluorescent, chemiluminescent, or chromogenic agents as well as substrates, cofactors, inhibitors, magnetic particles, and the like.

Host cells transformed with a polynucleotide sequence of interest may be cultured under conditions suitable for the expression and recovery of the protein from cell culture. The protein produced by a recombinant cell may be secreted or contained intracellularly depending on the sequence and/or the vector used. As will be understood by those of skill in the art, expression vectors containing polynucleotides of the invention may be designed to contain signal sequences which direct secretion of the encoded polypeptide through a prokaryotic or eukaryotic cell membrane. Other recombinant constructions may be used to join sequences encoding a polypeptide of interest to nucleotide sequence encoding a polypeptide domain which will facilitate purification of soluble proteins. Such purification facilitating domains include, but are not limited to, metal chelating peptides such as histidine-tryptophan modules that allow purification on immobilized metals, protein A domains that allow purification on immobilized immunoglobulin, and the domain utilized in the FLAGS extension/affinity purification system (Immunex Corp., Seattle, Wash.). The inclusion of cleavable linker sequences such as those specific for Factor XA or enterokinase (Invitrogen. San Diego, Calif.) between the purification domain and the encoded polypeptide may be used to facilitate purification. One such expression vector provides for expression of a fusion protein containing a polypeptide of interest and a nucleic acid encoding 6 histidine residues preceding a thioredoxin or an enterokinase cleavage site. The histidine residues facilitate purification on IMIAC (immnobilized metal ion affinity chromatography) as described in Porath, J. et al. (1992, *Prot. Exp. Purif.* 3:263–281) while the enterokinase cleavage site provides a means for purifying the desired polypeptide from the fusion protein. A discussion of vectors which contain fusion proteins is provided in Kroll, D. J. et al. (1993; *DNA Cell Biol.* 12:441–453).

In addition to recombinant production methods, polypeptides of the invention, and fragments thereof, may be produced by direct peptide synthesis using solid-phase techniques (Merrifield J. (1963) *J. Am. Chem. Soc.* 85:2149–2154). Protein synthesis may be performed using manual techniques or by automation. Automated synthesis may be achieved, for example, using Applied Biosystems 431A Peptide Synthesizer (Perkin Elmer). Alternatively, various fragments may be chemically synthesized separately and combined using chemical methods to produce the full length molecule.

Antibody Compositions, Fragments Thereof and Other Binding Agents

According to another aspect, the present invention further provides binding agents, such as antibodies and antigen-binding fragments thereof, that exhibit immunological binding to a tumor polypeptide disclosed herein, or to a portion, variant or derivative thereof. An antibody, or antigen-binding fragment thereof, is said to "specifically bind," "immunogically bind," and/or is "immunologically reactive" to a polypeptide of the invention if it reacts at a detectable level (within, for example, an ELISA assay) with the polypeptide, and does not react detectably with unrelated polypeptides under similar conditions.

Immunological binding, as used in this context, generally refers to the non-covalent interactions of the type which occur between an immunoglobulin molecule and an antigen for which the immunoglobulin is specific. The strength, or affinity of immunological binding interactions can be expressed in terms of the dissociation constant ($K_d$) of the interaction, wherein a smaller $K_d$ represents a greater affinity. Immunological binding properties of selected polypeptides can be quantified using methods well known in the art. One such method entails measuring the rates of antigen-binding site/antigen complex formation and dissociation, wherein those rates depend on the concentrations of the complex partners, the affinity of the interaction, and on geometric parameters that equally influence the rate in both directions. Thus, both the "on rate constant" ($K_{on}$) and the "off rate constant" ($K_{off}$) can be determined by calculation of the concentrations and the actual rates of association and dissociation. The ratio of $K_{off}/K_{on}$ enables cancellation of all parameters not related to affinity, and is thus equal to the dissociation constant $K_d$. See, generally, Davies et al. (1990) Annual Rev. Biochem. 59:439–473.

An "antigen-binding site," or "binding portion" of an antibody refers to the part of the immunoglobulin molecule that participates in antigen binding. The antigen binding site is formed by amino acid residues of the N-terminal variable ("V") regions of the heavy ("H") and light ("L") chains. Three highly divergent stretches within the V regions of the heavy and light chains are referred to as "hypervariable regions" which are interposed between more conserved flanking stretches known as "framework regions," or "FRs". Thus the term "FR" refers to amino acid sequences which are naturally found between and adjacent to hypervariable regions in immunoglobulins. In an antibody molecule, the three hypervariable regions of a light chain and the three hypervariable regions of a heavy chain are disposed relative to each other in three dimensional space to form an antigen-binding surface. The antigen-binding surface is complementary to the three-dimensional surface of a bound antigen, and the three hypervariable regions of each of the heavy and light chains are referred to as "complementarity-determining regions," or "CDRs."

Binding agents may be further capable of differentiating between patients with and without a cancer, such as prostate cancer, using the representative assays provided herein. For example, antibodies or other binding agents that bind to a tumor protein will preferably generate a signal indicating the presence of a cancer in at least about 20% of patients with the disease, more preferably at least about 30% of patients. Alternatively, or in addition, the antibody will generate a negative signal indicating the absence of the disease in at least about 90% of individuals without the cancer. To determine whether a binding agent satisfies this requirement, biological samples (e.g., blood, sera, sputum, urine and/or tumor biopsies) from patients with and without a cancer (as determined using standard clinical tests) may be assayed as described herein for the presence of polypeptides that bind to the binding agent. Preferably, a statistically significant number of samples with and without the disease will be assayed. Each binding agent should satisfy the above criteria; however, those of ordinary skill in the art will recognize that binding agents may be used in combination to improve sensitivity.

Any agent that satisfies the above requirements may be a binding agent. For example, a binding agent may be a ribosome, with or without a peptide component, an RNA molecule or a polypeptide. In a preferred embodiment, a binding agent is an antibody or an antigen-binding fragment thereof. Antibodies may be prepared by any of a variety of techniques known to those of ordinary skill in the art. See, e.g., Harlow and Lane, *Antibodies: A Laboratory Manual*, Cold Spring Harbor Laboratory, 1988. In general, antibodies can be produced by cell culture techniques, including the generation of monoclonal antibodies as described herein, or via transfection of antibody genes into suitable bacterial or mammalian cell hosts, in order to allow for the production of recombinant antibodies. In one technique, an immunogen comprising the polypeptide is initially injected into any of a wide variety of mammals (e.g., mice, rats, rabbits, sheep or goats). In this step, the polypeptides of this invention may serve as the immunogen without modification. Alternatively, particularly for relatively short polypeptides, a superior immune response may be elicited if the polypeptide is joined to a carrier protein, such as bovine serum albumin or keyhole limpet hemocyanin. The immunogen is injected into the animal host, preferably according to a predetermined schedule incorporating one or more booster immunizations, and the animals are bled periodically. Polyclonal antibodies specific for the polypeptide may then be purified from such antisera by, for example, affinity chromatography using the polypeptide coupled to a suitable solid support.

Monoclonal antibodies specific for an antigenic polypeptide of interest may be prepared, for example, using the technique of Kohler and Milstein, *Eur. J. Immunol.* 6:511–519, 1976, and improvements thereto. Briefly, these methods involve the preparation of immortal cell lines capable of producing antibodies having the desired specificity (i.e., reactivity with the polypeptide of interest). Such cell lines may be produced, for example, from spleen cells obtained from an animal immunized as described above. The spleen cells are then immortalized by, for example, fusion with a myeloma cell fusion partner, preferably one that is syngeneic with the immunized animal. A variety of fusion techniques may be employed. For example, the spleen cells and myeloma cells may be combined with a nonionic detergent for a few minutes and then plated at low density on a selective medium that supports the growth of hybrid cells, but not myeloma cells. A preferred selection technique uses HAT (hypoxanthine, aminopterin, thymidine) selection. After a sufficient time, usually about 1 to 2 weeks, colonies of hybrids are observed. Single colonies are selected and their culture supernatants tested for binding activity against the polypeptide. Hybridomas having high reactivity and specificity are preferred.

Monoclonal antibodies may be isolated from the supernatants of growing hybridoma colonies. In addition, various techniques may be employed to enhance the yield, such as injection of the hybridoma cell line into the peritoneal cavity of a suitable vertebrate host, such as a mouse. Monoclonal antibodies may then be harvested from the ascites fluid or the blood. Contaminants may be removed from the antibodies by conventional techniques, such as chromatography, gel filtration, precipitation, and extraction. The polypeptides of this invention may be used in the purification process in, for example, an affinity chromatography step.

A number of therapeutically useful molecules are known in the art which comprise antigen-binding sites that are capable of exhibiting immunological binding properties of an antibody molecule. The proteolytic enzyme papain preferentially cleaves IgG molecules to yield several fragments, two of which (the "F(ab)" fragments) each comprise a covalent heterodimer that includes an intact antigen-binding site. The enzyme pepsin is able to cleave IgG molecules to provide several fragments, including the "F(ab')$_2$" fragment which comprises both antigen-binding sites. An "Fv" fragment can be produced by preferential proteolytic cleavage of an IgM, and on rare occasions IgG or IgA immunoglobulin molecule. Fv fragments are, however, more commonly derived using recombinant techniques known in the art. The Fv fragment includes a non-covalent $V_H$::$V_L$ heterodimer including an antigen-binding site which retains much of the antigen recognition and binding capabilities of the native antibody molecule. Inbar et al. (1972) Proc. Nat. Acad. Sci. USA 69:2659–2662; Hochman et al. (1976) Biochem 15:2706–2710; and Ehrlich et al. (1980) Biochem 19:4091–4096.

A single chain Fv ("sFv") polypeptide is a covalently linked $V_H$::$V_L$ heterodimer which is expressed from a gene fusion including $V_H$- and $V_L$-encoding genes linked by a peptide-encoding linker. Huston et al. (1988) Proc. Nat. Acad. Sci. USA 85(16):5879–5883. A number of methods have been described to discern chemical structures for converting the naturally aggregated—but chemically separated—light and heavy polypeptide chains from an antibody V region into an sFv molecule which will fold into a three dimensional structure substantially similar to the structure of an antigen-binding site. See, e.g., U.S. Pat. Nos. 5,091,513 and 5,132,405, to Huston et al.; and U.S. Pat. No. 4,946,778, to Ladner et al.

Each of the above-described molecules includes a heavy chain and a light chain CDR set, respectively interposed between a heavy chain and a light chain FR set which provide support to the CDRS and define the spatial relationship of the CDRs relative to each other. As used herein, the term "CDR set" refers to the three hypervariable regions of a heavy or light chain V region. Proceeding from the N-terminus of a heavy or light chain, these regions are denoted as "CDR1," "CDR2," and "CDR3" respectively. An antigen-binding site, therefore, includes six CDRs, comprising the CDR set from each of a heavy and a light chain V region. A polypeptide comprising a single CDR, (e.g., a CDR1, CDR2 or CDR3) is referred to herein as a "molecular recognition unit." Crystallographic analysis of a number of antigen-antibody complexes has demonstrated that the amino acid residues of CDRs form extensive contact with bound antigen, wherein the most extensive antigen contact is with the heavy chain CDR3. Thus, the molecular recognition units are primarily responsible for the specificity of an antigen-binding site.

As used herein, the term "FR set" refers to the four flanking amino acid sequences which frame the CDRs of a CDR set of a heavy or light chain V region. Some FR residues may contact bound antigen; however, FRs are primarily responsible for folding the V region into the antigen-binding site, particularly the FR residues directly adjacent to the CDRS. Within FRs, certain amino residues and certain structural features are very highly conserved. In this regard, all V region sequences contain an internal disulfide loop of around 90 amino acid residues. When the V regions fold into a binding-site, the CDRs are displayed as projecting loop motifs which form an antigen-binding surface. It is generally recognized that there are conserved structural regions of FRs which influence the folded shape of the CDR loops into certain "canonical" structures—regardless of the precise CDR amino acid sequence. Further, certain FR residues are known to participate in non-covalent interdomain contacts which stabilize the interaction of the antibody heavy and light chains.

A number of "humanized" antibody molecules comprising an antigen-binding site derived from a non-human immunoglobulin have been described, including chimeric antibodies having rodent V regions and their associated CDRs fused to human constant domains (Winter et al. (1991) Nature 349:293–299; Lobuglio et al. (1989) Proc. Nat. Acad. Sci. USA 86:4220–4224; Shaw et al. (1987) J Immunol. 138:4534–4538; and Brown et al. (1987) Cancer Res. 47:3577–3583), rodent CDRs grafted into a human supporting FR prior to fusion with an appropriate human antibody constant domain (Riechmann et al. (1988) Nature 332:323–327; Verhoeyen et al. (1988) Science 239:1534–1536; and Jones et al. (1986) Nature 321:522–525), and rodent CDRs supported by recombinantly veneered rodent FRs (European Patent Publication No. 519,596, published Dec. 23, 1992). These "humanized" molecules are designed to minimize unwanted immunological response toward rodent antihuman antibody molecules which limits the duration and effectiveness of therapeutic applications of those moieties in human recipients.

As used herein, the terms "veneered FRs" and "recombinantly veneered FRs" refer to the selective replacement of FR residues from, e.g., a rodent heavy or light chain V region, with human FR residues in order to provide a xenogeneic molecule comprising an antigen-binding site which retains substantially all of the native FR polypeptide folding structure. Veneering techniques are based on the understanding that the ligand binding characteristics of an antigen-binding site are determined primarily by the structure and relative disposition of the heavy and light chain CDR sets within the antigen-binding surface. Davies et al. (1990) Ann. Rev. Biochem. 59:439–473. Thus, antigen binding specificity can be preserved in a humanized antibody only wherein the CDR structures, their interaction with each other, and their interaction with the rest of the V region domains are carefully maintained. By using veneering techniques, exterior (e.g., solvent-accessible) FR residues which are readily encountered by the immune system are selectively replaced with human residues to provide a hybrid molecule that comprises either a weakly immunogenic, or substantially non-immunogenic veneered surface.

The process of veneering makes use of the available sequence data for human antibody variable domains compiled by Kabat et al., in Sequences of Proteins of Immunological Interest, 4th ed., (U.S. Dept. of Health and Human Services, U.S. Government Printing Office, 1987), updates to the Kabat database, and other accessible U.S. and foreign databases (both nucleic acid and protein). Solvent accessibilities of V region amino acids can be deduced from the known three-dimensional structure for human and murine antibody fragments. There are two general steps in veneering a murine antigen-binding site. Initially, the FRs of the variable domains of an antibody molecule of interest are compared with corresponding FR sequences of human variable domains obtained from the above-identified sources. The most homologous human V regions are then compared residue by residue to corresponding murine amino acids. The residues in the murine FR which differ from the human counterpart are replaced by the residues present in the human moiety using recombinant techniques well known in the art. Residue switching is only carried out with moieties which are at least partially exposed (solvent accessible), and care is exercised in the replacement of amino acid residues which may have a significant effect on the tertiary structure of V region domains, such as proline, glycine and charged amino acids.

In this manner, the resultant "veneered" murine antigen-binding sites are thus designed to retain the murine CDR residues, the residues substantially adjacent to the CDRs, the residues identified as buried or mostly buried (solvent inaccessible), the residues believed to participate in non-covalent (e.g., electrostatic and hydrophobic) contacts between heavy and light chain domains, and the residues from conserved structural regions of the FRs which are believed to influence the "canonical" tertiary structures of the CDR loops. These design criteria are then used to prepare recombinant nucleotide sequences which combine the CDRs of both the heavy and light chain of a murine antigen-binding site into human-appearing FRs that can be used to transfect mammalian cells for the expression of recombinant human antibodies which exhibit the antigen specificity of the murine antibody molecule.

In another embodiment of the invention, monoclonal antibodies of the present invention may be coupled to one or more therapeutic agents. Suitable agents in this regard include radionuclides, differentiation inducers, drugs, toxins, and derivatives thereof. Preferred radionuclides include $^{90}$Y, $^{123}$I, $^{125}$I, $^{131}$I, $^{186}$Re, $^{188}$Re, $^{211}$At, and $^{212}$Bi. Preferred drugs include methotrexate, and pyrimidine and purine analogs. Preferred differentiation inducers include phorbol esters and butyric acid. Preferred toxins include ricin, abrin, diptheria toxin, cholera toxin, gelonin, Pseudomonas exotoxin, Shigella toxin, and pokeweed antiviral protein.

A therapeutic agent may be coupled (e.g., covalently bonded) to a suitable monoclonal antibody either directly or indirectly (e.g., via a linker group). A direct reaction between an agent and an antibody is possible when each possesses a substituent capable of reacting with the other. For example, a nucleophilic group, such as an amino or sulfhydryl group, on one may be capable of reacting with a carbonyl-containing group, such as an anhydride or an acid halide, or with an alkyl group containing a good leaving group (e.g., a halide) on the other.

Alternatively, it may be desirable to couple a therapeutic agent and an antibody via a linker group. A linker group can function as a spacer to distance an antibody from an agent in order to avoid interference with binding capabilities. A linker group can also serve to increase the chemical reactivity of a substituent on an agent or an antibody, and thus increase the coupling efficiency. An increase in chemical reactivity may also facilitate the use of agents, or functional groups on agents, which otherwise would not be possible.

It will be evident to those skilled in the art that a variety of bifunctional or polyfunctional reagents, both homo- and hetero-functional (such as those described in the catalog of the Pierce Chemical Co., Rockford, Ill.), may be employed as the linker group. Coupling may be effected, for example, through amino groups, carboxyl groups, sulfhydryl groups or oxidized carbohydrate residues. There are numerous references describing such methodology, e.g., U.S. Pat. No. 4,671,958, to Rodwell et al.

Where a therapeutic agent is more potent when free from the antibody portion of the immunoconjugates of the present invention, it may be desirable to use a linker group which is cleavable during or upon internalization into a cell. A number of different cleavable linker groups have been described. The mechanisms for the intracellular release of an agent from these linker groups include cleavage by reduction of a disulfide bond (e.g., U.S. Pat. No. 4,489,710, to Spitler), by irradiation of a photolabile bond (e.g., U.S. Pat. No. 4,625,014, to Senter et al.), by hydrolysis of derivatized amino acid side chains (e.g., U.S. Pat. No. 4,638,045, to Kohn et al.), by serum complement-mediated hydrolysis (e.g., U.S. Pat. No. 4,671,958, to Rodwell et al.), and acid-catalyzed hydrolysis (e.g., U.S. Pat. No. 4,569,789, to Blattler et al.).

It may be desirable to couple more than one agent to an antibody. In one embodiment, multiple molecules of an agent are coupled to one antibody molecule. In another embodiment, more than one type of agent may be coupled to one antibody. Regardless of the particular embodiment, immunoconjugates with more than one agent may be prepared in a variety of ways. For example, more than one agent may be coupled directly to an antibody molecule, or linkers that provide multiple sites for attachment can be used. Alternatively, a carrier can be used.

A carrier may bear the agents in a variety of ways, including covalent bonding either directly or via a linker group. Suitable carriers include proteins such as albumins (e.g., U.S. Pat. No. 4,507,234, to Kato et al.), peptides and polysaccharides such as aminodextran (e.g., U.S. Pat. No. 4,699,784, to Shih et al.). A carrier may also bear an agent by noncovalent bonding or by encapsulation, such as within a liposome vesicle (e.g., U.S. Pat. Nos. 4,429,008 and 4,873,088). Carriers specific for radionuclide agents include radiohalogenated small molecules and chelating compounds. For example, U.S. Pat. No. 4,735,792 discloses representative radiohalogenated small molecules and their synthesis. A radionuclide chelate may be formed from chelating compounds that include those containing nitrogen and sulfur atoms as the donor atoms for binding the metal, or metal oxide, radionuclide. For example, U.S. Pat. No. 4,673,562, to Davison et al. discloses representative chelating compounds and their synthesis.

T Cell Compositions

The present invention, in another aspect, provides T cells specific for a tumor polypeptide disclosed herein, or for a variant or derivative thereof. Such cells may generally be prepared in vitro or ex vivo, using standard procedures. For example, T cells may be isolated from bone marrow, peripheral blood, or a fraction of bone marrow or peripheral blood of a patient, using a commercially available cell separation system, such as the Isolex™ System, available from Nexell Therapeutics, Inc. (Irvine, Calif.; see also U.S. Pat. No. 5,240,856; U.S. Pat. No. 5,215,926; WO 89/06280; WO 91/16116 and WO 92/07243). Alternatively, T cells may be derived from related or unrelated humans, non-human mammals, cell lines or cultures.

T cells may be stimulated with a polypeptide, polynucleotide encoding a polypeptide and/or an antigen presenting cell (APC) that expresses such a polypeptide. Such stimulation is performed under conditions and for a time sufficient to permit the generation of T cells that are specific for the polypeptide of interest. Preferably, a tumor polypeptide or polynucleotide of the invention is present within a delivery vehicle, such as a microsphere, to facilitate the generation of specific T cells.

T cells are considered to be specific for a polypeptide of the present invention if the T cells specifically proliferate, secrete cytokines or kill target cells coated with the polypeptide or expressing a gene encoding the polypeptide. T cell specificity may be evaluated using any of a variety of standard techniques. For example, within a chromium release assay or proliferation assay, a stimulation index of more than two fold increase in lysis and/or proliferation, compared to negative controls, indicates T cell specificity. Such assays may be performed, for example, as described in Chen et al., Cancer Res. 54:1065–1070, 1994. Alternatively, detection of the proliferation of T cells may be accomplished by a variety of known techniques. For example, T cell proliferation can be detected by measuring an increased rate of DNA synthesis (e.g., by pulse-labeling cultures of T cells with tritiated thymidine and measuring the amount of tritiated thymidine incorporated into DNA). Contact with a tumor polypeptide (100 ng/ml–100 µg/ml, preferably 200 ng/ml–25 µg/ml) for 3–7 days will typically result in at least a two fold increase in proliferation of the T cells. Contact as described above for 2–3 hours should result in activation of the T cells, as measured using standard cytokine assays in which a two fold increase in the level of cytokine release (e.g., TNF or IFN-γ) is indicative of T cell activation (see Coligan et al., Current Protocols in Immunology, vol. 1, Wiley Interscience (Greene 1998)). T cells that have been activated in response to a tumor polypeptide, polynucleotide or polypeptide-expressing APC may be CD4$^+$ and/or CD8$^+$.

Tumor polypeptide-specific T cells may be expanded using standard techniques. Within preferred embodiments, the T cells are derived from a patient, a related donor or an unrelated donor, and are administered to the patient following stimulation and expansion.

For therapeutic purposes, CD4$^+$ or CD8$^+$ T cells that proliferate in response to a tumor polypeptide, polynucleotide or APC can be expanded in number either in vitro or in vivo. Proliferation of such T cells in vitro may be accomplished in a variety of ways. For example, the T cells can be re-exposed to a tumor polypeptide, or a short peptide corresponding to an immunogenic portion of such a polypeptide, with or without the addition of T cell growth factors, such as interleukin-2, and/or stimulator cells that synthesize a tumor polypeptide. Alternatively, one or more T cells that proliferate in the presence of the tumor polypeptide can be expanded in number by cloning. Methods for cloning cells are well known in the art, and include limiting dilution.

Pharmaceutical Compositions

In additional embodiments, the present invention concerns formulation of one or more of the polynucleotide, polypeptide, T-cell and/or antibody compositions disclosed herein in pharmaceutically-acceptable carriers for administration to a cell or an animal, either alone, or in combination with one or more other modalities of therapy.

It will be understood that, if desired, a composition as disclosed herein may be administered in combination with other agents as well, such as, e.g., other proteins or polypeptides or various pharmaceutically-active agents. In fact, there is virtually no limit to other components that may also be included, given that the additional agents do not cause a significant adverse effect upon contact with the target cells or host tissues. The compositions may thus be delivered along with various other agents as required in the particular instance. Such compositions may be purified from host cells or other biological sources, or alternatively may be chemically synthesized as described herein. Likewise, such compositions may further comprise substituted or derivatized RNA or DNA compositions.

Therefore, in another aspect of the present invention, pharmaceutical compositions are provided comprising one or more of the polynucleotide, polypeptide, antibody, and/or T-cell compositions described herein in combination with a physiologically acceptable carrier. In certain preferred embodiments, the pharmaceutical compositions of the invention comprise immunogenic polynucleotide and/or polypeptide compositions of the invention for use in prophylactic and theraputic vaccine applications. Vaccine preparation is generally described in, for example, M. F. Powell and M. J. Newman, eds., "Vaccine Design (the subunit and adjuvant approach)," Plenum Press (NY, 1995). Generally, such compositions will comprise one or more polynucleotide and/or polypeptide compositions of the present invention in combination with one or more immunostimulants.

It will be apparent that any of the pharmaceutical compositions described herein can contain pharmaceutically acceptable salts of the polynucleotides and polypeptides of the invention. Such salts can be prepared, for example, from pharmaceutically acceptable non-toxic bases, including organic bases (e.g., salts of primary, secondary and tertiary amines and basic amino acids) and inorganic bases (e.g., sodium, potassium, lithium, ammonium, calcium and magnesium salts).

In another embodiment, illustrative immunogenic compositions, e.g., vaccine compositions, of the present invention comprise DNA encoding one or more of the polypeptides as described above, such that the polypeptide is generated in situ. As noted above, the polynucleotide may be administered within any of a variety of delivery systems known to those of ordinary skill in the art. Indeed, numerous gene delivery techniques are well known in the art, such as those described by Rolland, Crit. Rev. Therap. Drug Carrier Systems 15:143–198, 1998, and references cited therein. Appropriate polynucleotide expression systems will, of course, contain the necessary regulatory DNA regulatory sequences for expression in a patient (such as a suitable promoter and terminating signal). Alternatively, bacterial delivery systems may involve the administration of a bacterium (such as Bacillus-Calmette-Guerrin) that expresses an immunogenic portion of the polypeptide on its cell surface or secretes such an epitope.

Therefore, in certain embodiments, polynucleotides encoding immunogenic polypeptides described herein are introduced into suitable mammalian host cells for expression using any of a number of known viral-based systems. In one illustrative embodiment, retroviruses provide a convenient and effective platform for gene delivery systems. A selected nucleotide sequence encoding a polypeptide of the present invention can be inserted into a vector and packaged in retroviral particles using techniques known in the art. The recombinant virus can then be isolated and delivered to a subject. A number of illustrative retroviral systems have been described (e.g., U.S. Pat. No. 5,219,740; Miller and Rosman (1989) BioTechniques 7:980–990; Miller, A. D. (1990) Human Gene Therapy 1:5–14; Scarpa et al. (1991) Virology 180:849–852; Burns et al. (1993) Proc. Natl. Acad. Sci. USA 90:8033–8037; and Boris-Lawrie and Temin (1993) Cur. Opin. Genet. Develop. 3:102–109.

In addition, a number of illustrative adenovirus-based systems have also been described. Unlike retroviruses which integrate into the host genome, adenoviruses persist extra-chromosomally thus minimizing the risks associated with insertional mutagenesis (Haj-Ahmad and Graham (1986) J. Virol. 57:267–274; Bett et al. (1993) J. Virol. 67:5911–5921; Mittereder et al. (1994) Human Gene Therapy 5:717–729; Seth et al. (1994) J. Virol. 68:933–94.0; Barr et al. (1994) Gene Therapy 1:51–58; Berkner, K. L. (1988) BioTechniques 6:616–629; and Rich et al. (1993) Human Gene Therapy 4:461–476).

Various adeno-associated virus (AAV) vector systems have also been developed for polynucleotide delivery. AAV vectors can be readily constructed using techniques well known in the art. See, e.g., U.S. Pat. Nos. 5,173,414 and 5,139,941; International Publication Nos. WO 92/01070 and WO 93/03769; Lebkowski et al. (1988) Molec. Cell. Biol. 8:3988–3996; Vincent et al. (1990) Vaccines 90 (Cold Spring Harbor Laboratory Press); Carter, B. J. (1992) Current Opinion in Biotechnology 3:533–539; Muzyczka, N. (1992) Current Topics in Microbiol. and Immunol. 158:97–129; Kotin, R. M. (1994) Human Gene Therapy 5:793–801; Shelling and Smith (1994) Gene Therapy 1:165–169; and Zhou et al. (1994) J. Exp. Med. 179:1867–1875.

Additional viral vectors useful for delivering the polynucleotides encoding polypeptides of the present invention by gene transfer include those derived from the pox family of viruses, such as vaccinia virus and avian poxvirus. By way of example, vaccinia virus recombinants expressing the novel molecules can be constructed as follows. The DNA encoding a polypeptide is first inserted into an appropriate vector so that it is adjacent to a vaccinia promoter and flanking vaccinia DNA sequences, such as the sequence encoding thymidine kinase (TK). This vector is then used to transfect cells which are simultaneously infected with vaccinia. Homologous recombination serves to insert the vaccinia promoter plus the gene encoding the polypeptide of interest into the viral genome. The resulting TK.sup.(−) recombinant can be selected by culturing the cells in the presence of 5-bromodeoxyuridine and picking viral plaques resistant thereto.

A vaccinia-based infection/transfection system can be conveniently used to provide for inducible, transient expression or coexpression of one or more polypeptides described herein in host cells of an organism. In this particular system, cells are first infected in vitro with a vaccinia virus recombinant that encodes the bacteriophage T7 RNA polymerase. This polymerase displays exquisite specificity in that it only transcribes templates bearing T7 promoters. Following infection, cells are transfected with the polynucleotide or polynucleotides of interest, driven by a T7 promoter. The polymerase expressed in the cytoplasm from the vaccinia virus recombinant transcribes the transfected DNA into RNA which is then translated into polypeptide by the host translational machinery. The method provides for high level, transient, cytoplasmic production of large quantities of RNA and its translation products. See, e.g., Elroy-Stein and Moss, Proc. Natl. Acad. Sci. USA (1990) 87:6743–6747; Fuerst et al. Proc. Natl. Acad. Sci. USA (1986) 83:8122–8126.

Alternatively, avipoxviruses, such as the fowlpox and canarypox viruses, can also be used to deliver the coding sequences of interest. Recombinant avipox viruses, expressing immunogens from mammalian pathogens, are known to confer protective immunity when administered to non-avian species. The use of an Avipox vector is particularly desirable in human and other mammalian species since members of the Avipox genus can only productively replicate in susceptible avian species and therefore are not infective in mammalian cells. Methods for producing recombinant Avipoxviruses are known in the art and employ genetic recombination, as described above with respect to the production of vaccinia viruses. See, e.g., WO 91/12882; WO 89/03429; and WO 92/03545.

Any of a number of alphavirus vectors can also be used for delivery of polynucleotide compositions of the present invention, such as those vectors described in U.S. Pat. Nos. 5,843,723; 6,015,686; 6,008,035 and 6,015,694. Certain vectors based on Venezuelan Equine Encephalitis (VEE) can also be used, illustrative examples of which can be found in U.S. Pat. Nos. 5,505,947 and 5,643,576.

Moreover, molecular conjugate vectors, such as the adenovirus chimeric vectors described in Michael et al. J. Biol. Chem. (1993) 268:6866–6869 and Wagner et al. Proc. Natl. Acad. Sci. USA (1992) 89:6099–6103, can also be used for gene delivery under the invention.

Additional illustrative information on these and other known viral-based delivery systems can be found, for example, in Fisher-Hoch et al., *Proc. Natl. Acad. Sci. USA* 86:317–321, 1989; Flexner et al., *Ann. N.Y. Acad. Sci.* 569:86–103, 1989; Flexner et al., *Vaccine* 8:17–21, 1990; U.S. Pat. Nos. 4,603,112, 4,769,330, and 5,017,487; WO 89/01973; U.S. Pat. No. 4,777,127; GB 2,200,651; EP 0,345,242; WO 91/02805; Berkner, *Biotechniques* 6:616–627, 1988; Rosenfeld et al., *Science* 252:431–434, 1991; Kolls et al., *Proc. Natl. Acad. Sci. USA* 91:215–219, 1994; Kass-Eisler et al., *Proc. Natl. Acad. Sci. USA* 90:11498–11502, 1993; Guzman et al., *Circulation* 88:2838–2848, 1993; and Guzman et al., *Cir. Res.* 73:1202–1207, 1993.

In certain embodiments, a polynucleotide may be integrated into the genome of a target cell. This integration may be in a specific location and orientation via homologous recombination (gene replacement) or it may be integrated in a random, non-specific location (gene augmentation). In yet further embodiments, the polynucleotide may be stably maintained in the cell as a separate, episomal segment of DNA. Such polynucleotide segments or "episomes" encode sequences sufficient to permit maintenance and replication independent of or in synchronization with the host cell cycle. The manner in which the expression construct is delivered to a cell and where in the cell the polynucleotide remains is dependent on the type of expression construct employed.

In another embodiment of the invention, a polynucleotide is administered/delivered as "naked" DNA, for example as described in Ulmer et al., *Science* 259:1745–1749, 1993 and reviewed by Cohen, *Science* 259:1691–1692, 1993. The uptake of naked DNA may be increased by coating the DNA onto biodegradable beads, which are efficiently transported into the cells.

In still another embodiment, a composition of the present invention can be delivered via a particle bombardment approach, many of which have been described. In one illustrative example, gas-driven particle acceleration can be achieved with devices such as those manufactured by Powderject Pharmaceuticals PLC (Oxford, UK) and Powderject Vaccines Inc. (Madison, Wis.), some examples of which are described in U.S. Pat. Nos. 5,846,796; 6,010,478; 5,865,796; 5,584,807; and EP Patent No. 0500 799. This approach offers a needle-free delivery approach wherein a dry powder formulation of microscopic particles, such as polynucleotide or polypeptide particles, are accelerated to high speed within a helium gas jet generated by a hand held device, propelling the particles into a target tissue of interest.

In a related embodiment, other devices and methods that may be useful for gas-driven needle-less injection of compositions of the present invention include those provided by Bioject, Inc. (Portland, Oreg.), some examples of which are described in U.S. Pat. Nos. 4,790,824; 5,064,413; 5,312,335; 5,383,851; 5,399,163; 5,520,639 and 5,993,412.

According to another embodiment, the pharmaceutical compositions described herein will comprise one or more immunostimulants in addition to the immunogenic polynucleotide, polypeptide, antibody, T-cell and/or APC compositions of this invention. An immunostimulant refers to essentially any substance that enhances or potentiates an immune response (antibody and/or cell-mediated) to an exogenous antigen. One preferred type of immunostimulant comprises an adjuvant. Many adjuvants contain a substance designed to protect the antigen from rapid catabolism, such as aluminum hydroxide or mineral oil, and a stimulator of immune responses, such as lipid A, Bortadella pertussis or *Mycobacterium tuberculosis* derived proteins. Certain adjuvants are commercially available as, for example, Freund's Incomplete Adjuvant and Complete Adjuvant (Difco Laboratories, Detroit, Mich.); Merck Adjuvant 65 (Merck and Company, Inc., Rahway, N.J.); AS-2 (SmithKline Beecham, Philadelphia, Pa.); aluminum salts such as aluminum hydroxide gel (alum) or aluminum phosphate; salts of calcium, iron or zinc; an insoluble suspension of acylated tyrosine; acylated sugars; cationically or anionically derivatized polysaccharides; polyphosphazenes; biodegradable microspheres; monophosphoryl lipid A and quil A. Cytokines, such as GM-CSF, interleukin-2, -7, -12, and other like growth factors, may also be used as adjuvants.

Within certain embodiments of the invention, the adjuvant composition is preferably one that induces an immune response predominantly of the Th1 type. High levels of Th1-type cytokines (e.g., IFN-γ, TNFα, IL-2 and IL-12) tend to favor the induction of cell mediated immune responses to an administered antigen. In contrast, high levels of Th2-type cytokines (e.g., IL-4, IL-5, IL-6 and IL-10) tend to favor the induction of humoral immune responses. Following application of a vaccine as provided herein, a patient will support an immune response that includes Th1- and Th2-type responses. Within a preferred embodiment, in which a response is predominantly Th1-type, the level of Th1-type cytokines will increase to a greater extent than the level of Th2-type cytokines. The levels of these cytokines may be readily assessed using standard assays. For a review of the families of cytokines, see Mosmann and Coffman, *Ann. Rev. Immunol.* 7:145–173, 1989.

Certain preferred adjuvants for eliciting a predominantly Th1-type response include, for example, a combination of monophosphoryl lipid A, preferably 3-de-O-acylated monophosphoryl lipid A, together with an aluminum salt. MPL® adjuvants are available from Corixa Corporation (Seattle, Wash.; see, for example, U.S. Pat. Nos. 4,436,727; 4,877,611; 4,866,034 and 4,912,094). CpG-containing oligonucleotides (in which the CpG dinucleotide is unmethylated) also induce a predominantly Th1 response. Such oligonucleotides are well known and are described, for example, in WO 96/02555, WO 99/33488 and U.S. Pat. Nos. 6,008,200 and 5,856,462. Immunostimulatory DNA sequences are also described, for example, by Sato et al., *Science* 273:352, 1996. Another preferred adjuvant comprises a saponin, such as Quil A, or derivatives thereof, including QS21 and QS7 (Aquila Biopharmaceuticals Inc., Framingham, Mass.); Escin; Digitonin; or Gypsophila or *Chenopodium quinoa* saponins. Other preferred formulations include more than one saponin in the adjuvant combinations of the present invention, for example combinations of at least two of the following group comprising QS21, QS7, Quil A, β-escin, or digitonin.

Alternatively the saponin formulations may be combined with vaccine vehicles composed of chitosan or other polycationic polymers, polylactide and polylactide-co-glycolide particles, poly-N-acetyl glucosamine-based polymer matrix, particles composed of polysaccharides or chemically modified polysaccharides, liposomes and lipid-based particles, particles composed of glycerol monoesters, etc. The saponins may also be formulated in the presence of cholesterol to form particulate structures such as liposomes or ISCOMs. Furthermore, the saponins may be formulated together with a polyoxyethylene ether or ester, in either a non-particulate solution or suspension, or in a particulate structure such as a paucilamelar liposome or ISCOM. The saponins may also be formulated with excipients such as Carbopol® to increase viscosity, or may be formulated in a dry powder form with a powder excipient such as lactose.

In one preferred embodiment, the adjuvant system includes the combination of a monophosphoryl lipid A and a saponin derivative, such as the combination of QS21 and 3D-MPL® adjuvant, as described in WO 94/00153, or a less reactogenic composition where the QS21 is quenched with cholesterol, as described in WO 96/33739. Other preferred formulations comprise an oil-in-water emulsion and tocopherol. Another particularly preferred adjuvant formulation employing QS21, 3D-MPL® adjuvant and tocopherol in an oil-in-water emulsion is described in WO 95/17210.

Another enhanced adjuvant system involves the combination of a CpG-containing oligonucleotide and a saponin derivative particularly the combination of CpG and QS21 is disclosed in WO 00/09159. Preferably the formulation additionally comprises an oil in water emulsion and tocopherol.

Additional illustrative adjuvants for use in the pharmaceutical compositions of the invention include Montanide ISA 720 (Seppic, France), SAF (Chiron, Calif., United States), ISCOMS (CSL), MF-59 (Chiron), the SBAS series of adjuvants (e.g., SBAS-2 or SBAS-4, available from SmithKline Beecham, Rixensart, Belgium), Detox (Enhanzyn®; Corixa, Hamilton, Mont.), RC-529 (Corixa, Hamilton, Mont.) and other aminoalkyl glucosaminide 4-phosphates (AGPs), such as those described in pending U.S. patent application Ser. Nos. 08/853,826 and 09/074,720, the disclosures of which are incorporated herein by reference in their entireties, and polyoxyethylene ether adjuvants such as those described in WO 99/52549A1.

Other preferred adjuvants include adjuvant molecules of the general formula

$$HO(CH_2CH_2O)_n—A—R, \quad (I):$$

wherein, n is 1–50, A is a bond or —C(O)—, R is $C_{1-50}$ alkyl or Phenyl $C_{1-50}$ alkyl.

One embodiment of the present invention consists of a vaccine formulation comprising a polyoxyethylene ether of general formula (I), wherein n is between 1 and 50, preferably 4–24, most preferably 9; the R component is $C_{1-50}$, preferably $C_4$–$C_{20}$ alkyl and most preferably $C_{12}$ alkyl, and A is a bond. The concentration of the polyoxyethylene ethers should be in the range 0.1–20%, preferably from 0.1–10%, and most preferably in the range 0.1–1%. Preferred polyoxyethylene ethers are selected from the following group: polyoxyethylene-9-lauryl ether, polyoxyethylene-9-steoryl ether, polyoxyethylene-8-steoryl ether, polyoxyethylene-4-lauryl ether, polyoxyethylene-35-lauryl ether, and polyoxyethylene-23-lauryl ether. Polyoxyethylene ethers such as polyoxyethylene lauryl ether are described in the Merck index ($12^{th}$ edition: entry 7717). These adjuvant molecules are described in WO 99/52549. The polyoxyethylene ether according to the general formula (I) above may, if desired, be combined with another adjuvant. For example, a preferred adjuvant combination is preferably with CpG as described in the pending UK patent application GB 9820956.2.

According to another embodiment of this invention, an immunogenic composition described herein is delivered to a host via antigen presenting cells (APCs), such as dendritic cells, macrophages, B cells, monocytes and other cells that may be engineered to be efficient APCs. Such cells may, but need not, be genetically modified to increase the capacity for presenting the antigen, to improve activation and/or maintenance of the T cell response, to have anti-tumor effects per se and/or to be immunologically compatible with the receiver (i.e., matched HLA haplotype). APCs may generally be isolated from any of a variety of biological fluids and organs, including tumor and peritumoral tissues, and may be autologous, allogeneic, syngeneic or xenogeneic cells.

Certain preferred embodiments of the present invention use dendritic cells or progenitors thereof as antigen-presenting cells. Dendritic cells are highly potent APCs (Banchereau and Steinman, *Nature* 392:245–251, 1998) and have been shown to be effective as a physiological adjuvant for eliciting prophylactic or therapeutic antitumor immunity (see Timmerman and Levy, *Ann. Rev. Med.* 50:507–529, 1999). In general, dendritic cells may be identified based on their typical shape (stellate in situ, with marked cytoplasmic processes (dendrites) visible in vitro), their ability to take up, process and present antigens with high efficiency and their ability to activate naïve T cell responses. Dendritic cells may, of course, be engineered to express specific cell-surface receptors or ligands that are not commonly found on dendritic cells in vivo or ex vivo, and such modified dendritic cells are contemplated by the present invention. As an alternative to dendritic cells, secreted vesicles antigen-loaded dendritic cells (called exosomes) may be used within a vaccine (see Zitvogel et al., *Nature Med.* 4:594–600, 1998).

Dendritic cells and progenitors may be obtained from peripheral blood, bone marrow, tumor-infiltrating cells, peritumoral tissues-infiltrating cells, lymph nodes, spleen, skin, umbilical cord blood or any other suitable tissue or fluid. For example, dendritic cells may be differentiated ex vivo by adding a combination of cytokines such as GM-CSF, IL-4, IL-13 and/or TNFα to cultures of monocytes harvested from peripheral blood. Alternatively, CD34 positive cells harvested from peripheral blood, umbilical cord blood or bone marrow may be differentiated into dendritic cells by adding to the culture medium combinations of GM-CSF, IL-3, TNFα, CD40 ligand, LPS, flt3 ligand and/or other compound(s) that induce differentiation, maturation and proliferation of dendritic cells.

Dendritic cells are conveniently categorized as "immature" and "mature" cells, which allows a simple way to discriminate between two well characterized phenotypes. However, this nomenclature should not be construed to exclude all possible intermediate stages of differentiation. Immature dendritic cells are characterized as APC with a high capacity for antigen uptake and processing, which correlates with the high expression of Fcγ receptor and mannose receptor. The mature phenotype is typically characterized by a lower expression of these markers, but a high expression of cell surface molecules responsible for T cell activation such as class I and class II MHC, adhesion molecules (e.g., CD54 and CD11) and costimulatory molecules (e.g., CD40, CD80, CD86 and 4-1BB).

APCs may generally be transfected with a polynucleotide of the invention (or portion or other variant thereof) such that the encoded polypeptide, or an immunogenic portion thereof, is expressed on the cell surface. Such transfection may take place ex vivo, and a pharmaceutical composition comprising such transfected cells may then be used for therapeutic purposes, as described herein. Alternatively, a gene delivery vehicle that targets a dendritic or other antigen presenting cell may be administered to a patient, resulting in transfection that occurs in vivo. In vivo and ex vivo transfection of dendritic cells, for example, may generally be performed using any methods known in the art, such as those described in WO 97/24447, or the gene gun approach described by Mahvi et al., *Immunology and cell Biology* 75:456–460, 1997. Antigen loading of dendritic cells may be achieved by incubating dendritic cells or progenitor cells with the tumor polypeptide, DNA (naked or within a plasmid vector) or RNA; or with antigen-expressing recombinant bacterium or viruses (e.g., vaccinia, fowlpox, adenovirus or lentivirus vectors). Prior to loading, the polypeptide may be covalently conjugated to an immunological partner that provides T cell help (e.g., a carrier molecule). Alternatively, a dendritic cell may be pulsed with a non-conjugated immunological partner, separately or in the presence of the polypeptide.

While any suitable carrier known to those of ordinary skill in the art may be employed in the pharmaceutical compositions of this invention, the type of carrier will typically vary depending on the mode of administration. Compositions of the present invention may be formulated for any appropriate manner of administration, including for example, topical, oral, nasal, mucosal, intravenous, intracranial, intraperitoneal, subcutaneous and intramuscular administration.

Carriers for use within such pharmaceutical compositions are biocompatible, and may also be biodegradable. In certain embodiments, the formulation preferably provides a relatively constant level of active component release. In other embodiments, however, a more rapid rate of release immediately upon administration may be desired. The formulation of such compositions is well within the level of ordinary skill in the art using known techniques. Illustrative carriers useful in this regard include microparticles of poly(lactide-co-glycolide), polyacrylate, latex, starch, cellulose, dextran and the like. Other illustrative delayed-release carriers include supramolecular biovectors, which comprise a non-liquid hydrophilic core (e.g., a cross-linked polysaccharide or oligosaccharide) and, optionally, an external layer comprising an amphiphilic compound, such as a phospholipid (see e.g., U.S. Pat. No. 5,151,254 and PCT applications WO 94/20078, WO/94/23701 and WO 96/06638). The amount of active compound contained within a sustained release formulation depends upon the site of implantation, the rate and expected duration of release and the nature of the condition to be treated or prevented.

In another illustrative embodiment, biodegradable microspheres (e.g., polylactate polyglycolate) are employed as carriers for the compositions of this invention.

Suitable biodegradable microspheres are disclosed, for example, in U.S. Pat. Nos. 4,897,268; 5,075,109; 5,928,647; 5,811,128; 5,820,883; 5,853,763; 5,814,344, 5,407,609 and 5,942,252. Modified hepatitis B core protein carrier systems such as described in WO/99 40934, and references cited therein, will also be useful for many applications. Another illustrative carrier/delivery system employs a carrier comprising particulate-protein complexes, such as those described in U.S. Pat. No. 5,928,647, which are capable of inducing a class I-restricted cytotoxic T lymphocyte responses in a host.

The pharmaceutical compositions of the invention will often further comprise one or more buffers (e.g., neutral buffered saline or phosphate buffered saline), carbohydrates (e.g., glucose, mannose, sucrose or dextrans), mannitol, proteins, polypeptides or amino acids such as glycine, antioxidants, bacteriostats, chelating agents such as EDTA or glutathione, adjuvants (e.g., aluminum hydroxide), solutes that render the formulation isotonic, hypotonic or weakly hypertonic with the blood of a recipient, suspending agents, thickening agents and/or preservatives. Alternatively, compositions of the present invention may be formulated as a lyophilizate.

The pharmaceutical compositions described herein may be presented in unit-dose or multi-dose containers, such as sealed ampoules or vials. Such containers are typically sealed in such a way to preserve the sterility and stability of the formulation until use. In general, formulations may be stored as suspensions, solutions or emulsions in oily or aqueous vehicles. Alternatively, a pharmaceutical composition may be stored in a freeze-dried condition requiring only the addition of a sterile liquid carrier immediately prior to use.

The development of suitable dosing and treatment regimens for using the particular compositions described herein in a variety of treatment regimens, including e.g., oral, parenteral, intravenous, intranasal, and intramuscular administration and formulation,. is well known in the art, some of which are briefly discussed below for general purposes of illustration.

In certain applications, the pharmaceutical compositions disclosed herein may be delivered via oral administration to an animal. As such, these compositions may be formulated with an inert diluent or with an assimilable edible carrier, or they may be enclosed in hard- or soft-shell gelatin capsule, or they may be compressed into tablets, or they may be incorporated directly with the food of the diet.

The active compounds may even be incorporated with excipients and used in the form of ingestible tablets, buccal tables, troches, capsules, elixirs, suspensions, syrups, wafers, and the like (see, for example, Mathiowitz et al., Nature Mar. 27, 1997;386(6623):410–4; Hwang et al., Crit Rev Ther Drug Carrier Syst 1998;15(3):243–84; U.S. Pat. No. 5,641,515; U.S. Pat. No. 5,580,579 and U.S. Pat. No. 5,792,451). Tablets, troches, pills, capsules and the like may also contain any of a variety of additional components, for example, a binder, such as gum tragacanth, acacia, cornstarch, or gelatin; excipients, such as dicalcium phosphate; a disintegrating agent, such as corn starch, potato starch, alginic acid and the like; a lubricant, such as magnesium stearate; and a sweetening agent, such as sucrose, lactose or saccharin may be added or a flavoring agent, such as peppermint, oil of wintergreen, or cherry flavoring. When the dosage unit form is a capsule, it may contain, in addition to materials of the above type, a liquid carrier. Various other materials may be present as coatings or to otherwise modify the physical form of the dosage unit. For instance, tablets, pills, or capsules may be coated with shellac, sugar, or both. Of course, any material used in preparing any dosage unit form should be pharmaceutically pure and substantially non-toxic in the amounts employed. In addition, the active compounds may be incorporated into sustained-release preparation and formulations.

Typically, these formulations will contain at least about 0.1% of the active compound or more, although the percentage of the active ingredient(s) may, of course, be varied and may conveniently be between about 1 or 2% and about 60% or 70% or more of the weight or volume of the total formulation. Naturally, the amount of active compound(s) in each therapeutically useful composition may be prepared is such a way that a suitable dosage will be obtained in any given unit dose of the compound. Factors such as solubility, bioavailability, biological half-life, route of administration, product shelf life, as well as other pharmacological considerations will be contemplated by one skilled in the art of preparing such pharmaceutical formulations, and as such, a variety of dosages and treatment regimens may be desirable.

For oral administration, the compositions of the present invention may alternatively be incorporated with one or more excipients in the form of a mouthwash, dentifrice, buccal tablet, oral spray, or sublingual orally-administered formulation. Alternatively, the active ingredient may be incorporated into an oral solution such as one containing sodium borate, glycerin and potassium bicarbonate, or dispersed in a dentifrice, or added in a therapeutically-effective amount to a composition that may include water, binders, abrasives, flavoring agents, foaming agents, and humectants. Alternatively the compositions may be fashioned into a tablet or solution form that may be placed under the tongue or otherwise dissolved in the mouth.

In certain circumstances it will be desirable to deliver the pharmaceutical compositions disclosed herein parenterally, intravenously, intramuscularly, or even intraperitoneally. Such approaches are well known to the skilled artisan, some of which are further described, for example, in U.S. Pat. No. 5,543,158; U.S. Pat. No. 5,641,515 and U.S. Pat. No. 5,399,363. In certain embodiments, solutions of the active compounds as free base or pharmacologically acceptable salts may be prepared in water suitably mixed with a surfactant, such as hydroxypropylcellulose. Dispersions may also be prepared in glycerol, liquid polyethylene glycols, and mixtures thereof and in oils. Under ordinary conditions of storage and use, these preparations generally will contain a preservative to prevent the growth of microorganisms.

Illustrative pharmaceutical forms suitable for injectable use include sterile aqueous solutions or dispersions and sterile powders for the extemporaneous preparation of sterile injectable solutions or dispersions (for example, see U.S. Pat. No. 5,466,468). In all cases the form must be sterile and must be fluid to the extent that easy syringability exists. It must be stable under the conditions of manufacture and storage and must be preserved against the contaminating action of microorganisms, such as bacteria and fungi. The carrier can be a solvent or dispersion medium containing, for example, water, ethanol, polyol (e.g., glycerol, propylene glycol, and liquid polyethylene glycol, and the like), suitable mixtures thereof, and/or vegetable oils. Proper fluidity may be maintained, for example, by the use of a coating, such as lecithin, by the maintenance of the required particle size in the case of dispersion and/or by the use of surfactants. The prevention of the action of microorganisms can be facilitated by various antibacterial and antifungal agents, for example, parabens, chlorobutanol, phenol, sorbic acid, thimerosal, and the like. In many cases, it will be preferable to include isotonic agents, for example, sugars or sodium chloride. Prolonged absorption of the injectable compositions can be brought about by the use in the compositions of agents delaying absorption, for example, aluminum monostearate and gelatin.

In one embodiment, for parenteral administration in an aqueous solution, the solution should be suitably buffered if necessary and the liquid diluent first rendered isotonic with sufficient saline or glucose. These particular aqueous solutions are especially suitable for intravenous, intramuscular, subcutaneous and intraperitoneal administration. In this connection, a sterile aqueous medium that can be employed will be known to those of skill in the art in light of the present disclosure. For example, one dosage may be dissolved in 1 ml of isotonic NaCl solution and either added to 1000 ml of hypodermoclysis fluid or injected at the proposed site of infusion, (see for example, "Remington's Pharmaceutical Sciences" 15th Edition, pages 1035–1038 and 1570–1580). Some variation in dosage will necessarily occur depending on the condition of the subject being treated. Moreover, for human administration, preparations will of course preferably meet sterility, pyrogenicity, and the general safety and purity standards as required by FDA Office of Biologics standards.

In another embodiment of the invention, the compositions disclosed herein may be formulated in a neutral or salt form. Illustrative pharmaceutically-acceptable salts include the acid addition salts (formed with the free amino groups of the protein) and which are formed with inorganic acids such as, for example, hydrochloric or phosphoric acids, or such organic acids as acetic, oxalic, tartaric, mandelic, and the like. Salts formed with the free carboxyl groups can also be derived from inorganic bases such as, for example, sodium, potassium, ammonium, calcium, or ferric hydroxides, and such organic bases as isopropylamine, trimethylamine, histidine, procaine and the like. Upon formulation, solutions will be administered in a manner compatible with the dosage formulation and in such amount as is therapeutically effective.

The carriers can further comprise any and all solvents, dispersion media, vehicles, coatings, diluents, antibacterial and antifungal agents, isotonic and absorption delaying agents, buffers, carrier solutions, suspensions, colloids, and the like. The use of such media and agents for pharmaceutical active substances is well known in the art. Except insofar as any conventional media or agent is incompatible with the active ingredient, its use in the therapeutic compositions is contemplated. Supplementary active ingredients can also be incorporated into the compositions. The phrase "pharmaceutically-acceptable" refers to molecular entities and compositions that do not produce an allergic or similar untoward reaction when administered to a human.

In certain embodiments, the pharmaceutical compositions may be delivered by intranasal sprays, inhalation, and/or other aerosol delivery vehicles. Methods for delivering genes, nucleic acids, and peptide compositions directly to the lungs via nasal aerosol sprays has been described, e.g., in U.S. Pat. No. 5,756,353 and U.S. Pat. No. 5,804,212. Likewise, the delivery of drugs using intranasal microparticle resins (Takenaga et al., J Controlled Release Mar. 2, 1998;52(1–2):81–7) and lysophosphatidyl-glycerol compounds (U.S. Pat. No. 5,725,871) are also well-known in the pharmaceutical arts. Likewise, illustrative transmucosal drug delivery in the form of a polytetrafluoroetheylene support matrix is described in U.S. Pat. No. 5,780,045.

In certain embodiments, liposomes, nanocapsules, microparticles, lipid particles, vesicles, and the like, are used for the introduction of the compositions of the present invention into suitable host cells/organisms. In particular, the compositions of the present invention may be formulated for delivery either encapsulated in a lipid particle, a liposome, a vesicle, a nanosphere, or a nanoparticle or the like. Alternatively, compositions of the present invention can be bound, either covalently or non-covalently, to the surface of such carrier vehicles.

The formation and use of liposome and liposome-like preparations as potential drug carriers is generally known to those of skill in the art (see for example, Lasic, Trends Biotechnol July 1998;16(7):307–21; Takakura, Nippon Rinsho March 1998;56(3):691–5; Chandran et al., Indian J Exp Biol. August 1997;35(8):801–9; Margalit, Crit Rev Ther Drug Carrier Syst. 1995;12(2–3):233–61; U.S. Pat. No. 5,567,434; U.S. Pat. No. 5,552,157; U.S. Pat. No. 5,565,213; U.S. Pat. No. 5,738,868 and U.S. Pat. No. 5,795,587, each specifically incorporated herein by reference in its entirety).

Liposomes have been used successfully with a number of cell types that are normally difficult to transfect by other procedures, including T cell suspensions, primary hepatocyte cultures and PC 12 cells (Renneisen et al., J Biol Chem. Sep. 25, 1990;265(27):16337–42; Muller et al., DNA Cell Biol. April 1990;9(3):221–9). In addition, liposomes are free of the DNA length constraints that are typical of viral-based delivery systems. Liposomes have been used effectively to introduce genes, various drugs, radiotherapeutic agents, enzymes, viruses, transcription factors, allosteric effectors and the like, into a variety of cultured cell lines and animals. Furthermore, he use of liposomes does not appear to be associated with autoimmune responses or unacceptable toxicity after systemic delivery.

In certain embodiments, liposomes are formed from phospholipids that are dispersed in an aqueous medium and spontaneously form multilamellar concentric bilayer vesicles (also termed multilamellar vesicles (MLVs).

Alternatively, in other embodiments, the invention provides for pharmaceutically-acceptable nanocapsule formulations of the compositions of the present invention. Nanocapsules can generally entrap compounds in a stable and reproducible way (see, for example, Quintanar-Guerrero et al., Drug Dev Ind Pharm. 1998 Dec;24(12):1113–28). To avoid side effects due to intracellular polymeric overloading, such ultrafine particles (sized around 0.1 $\mu$m) may be designed using polymers able to be degraded in vivo. Such particles can be made as described, for example, by Couvreur et al., Crit Rev Ther Drug Carrier Syst. 1988;5(1):1–20; zur Muhlen et al., Eur J Pharm Biopharm. 1998 Mar;45(2):149–55; Zambaux et al. J Controlled Release. 1998 Jan 2;50(1–3):31–40; and U.S. Pat. No. 5,145,684.

Cancer Therapeutic Methods

In further aspects of the present invention, the pharmaceutical compositions described herein may be used for the treatment of cancer, particularly for the immunotherapy of prostate cancer. Within such methods, the pharmaceutical compositions described herein are administered to a patient, typically a warm-blooded animal, preferably a human. A patient may or may not be afflicted with cancer. Accordingly, the above pharmaceutical compositions may be used to prevent the development of a cancer or to treat a patient afflicted with a cancer. Pharmaceutical compositions and vaccines may be administered either prior to or following surgical removal of primary tumors and/or treatment such as administration of radiotherapy or conventional chemotherapeutic drugs. As discussed above, administration of the pharmaceutical compositions may be by any suitable method, including administration by intravenous, intraperitoneal, intramuscular, subcutaneous, intranasal, intradermal, anal, vaginal, topical and oral routes.

Within certain embodiments, immunotherapy may be active immunotherapy, in which treatment relies on the in vivo stimulation of the endogenous host immune system to react against tumors with the administration of immune response-modifying agents (such as polypeptides and polynucleotides as provided herein).

Within other embodiments, immunotherapy may be passive immunotherapy, in which treatment involves the delivery of agents with established tumor-immune reactivity (such as effector cells or antibodies) that can directly or indirectly mediate antitumor effects and does not necessarily depend on an intact host immune system. Examples of effector cells include T cells as discussed above, T lymphocytes (such as CD8$^+$ cytotoxic T lymphocytes and CD4$^+$ T-helper tumor-infiltrating lymphocytes), killer cells (such as Natural Killer cells and lymphokine-activated killer cells), B cells and antigen-presenting cells (such as dendritic cells and macrophages) expressing a polypeptide provided herein. T cell receptors and antibody receptors specific for the polypeptides recited herein may be cloned, expressed and transferred into other vectors or effector cells for adoptive immunotherapy. The polypeptides provided herein may also be used to generate antibodies or anti-idiotypic antibodies (as described above and in U.S. Pat. No. 4,918,164) for passive immunotherapy.

Effector cells may generally be obtained in sufficient quantities for adoptive immunotherapy by growth in vitro, as described herein. Culture conditions for expanding single antigen-specific effector cells to several billion in number with retention of antigen recognition in vivo are well known in the art. Such in vitro culture conditions typically use intermittent stimulation with antigen, often in the presence of cytokines (such as IL-2) and non-dividing feeder cells. As noted above, immunoreactive polypeptides as provided herein may be used to rapidly expand antigen-specific T cell cultures in order to generate a sufficient number of cells for immunotherapy. In particular, antigen-presenting cells, such as dendritic, macrophage, monocyte, fibroblast and/or B cells, may be pulsed with immunoreactive polypeptides or transfected with one or more polynucleotides using standard techniques well known in the art. For example, antigen-presenting cells can be transfected with a polynucleotide having a promoter appropriate for increasing expression in a recombinant virus or other expression system. Cultured effector cells for use in therapy must be able to grow and distribute widely, and to survive long term in vivo. Studies have shown that cultured effector cells can be induced to grow in vivo and to survive long term in substantial numbers by repeated stimulation with antigen supplemented with IL-2 (see, for example, Cheever et al., Immunological Reviews 157:177, 1997).

Alternatively, a vector expressing a polypeptide recited herein may be introduced into antigen presenting cells taken from a patient and clonally propagated ex vivo for transplant back into the same patient. Transfected cells may be reintroduced into the patient using any means known in the art, preferably in sterile form by intravenous, intracavitary, intraperitoneal or intratumor administration.

Routes and frequency of administration of the therapeutic compositions described herein, as well as dosage, will vary from individual to individual, and may be readily established using standard techniques. In general, the pharmaceutical compositions and vaccines may be administered by injection (e.g., intracutaneous, intramuscular, intravenous or subcutaneous), intranasally (e.g., by aspiration) or orally. Preferably, between 1 and 10 doses may be administered over a 52 week period. Preferably, 6 doses are administered, at intervals of 1 month, and booster vaccinations may be given periodically thereafter. Alternate protocols may be appropriate for individual patients. A suitable dose is an amount of a compound that, when administered as described above, is capable of promoting an anti-tumor immune response, and is at least 10–50% above the basal (i.e., untreated) level. Such response can be monitored by measuring the anti-tumor antibodies in a patient or by vaccine-dependent generation of cytolytic effector cells capable of killing the patient's tumor cells in vitro. Such vaccines should also be capable of causing an immune response that leads to an improved clinical outcome (e.g., more frequent remissions, complete or partial or longer disease-free survival) in vaccinated patients as compared to non-vaccinated patients. In general, for pharmaceutical compositions and vaccines comprising one or more polypeptides, the amount of each polypeptide present in a dose ranges from about 25 $\mu$g to 5 mg per kg of host. Suitable dose sizes will vary with the size of the patient, but will typically range from about 0.1 mL to about 5 mL.

In general, an appropriate dosage and treatment regimen provides the active compound(s) in an amount sufficient to provide therapeutic and/or prophylactic benefit. Such a response can be monitored by establishing an improved clinical outcome (e.g., more frequent remissions, complete or partial, or longer disease-free survival) in treated patients as compared to non-treated patients. Increases in preexisting immune responses to a tumor protein generally correlate with an improved clinical outcome. Such immune responses may generally be evaluated using standard proliferation, cytotoxicity or cytokine assays, which may be performed using samples obtained from a patient before and after treatment.

Cancer Detection and Diagnostic Compositions, Methods and Kits

In general, a cancer may be detected in a patient based on the presence of one or more prostate tumor proteins and/or polynucleotides encoding such proteins in a biological sample (for example, blood, sera, sputum urine and/or tumor biopsies) obtained from the patient. In other words, such proteins may be used as markers to indicate the presence or absence of a cancer such as prostate cancer. In addition, such proteins may be useful for the detection of other cancers. The binding agents provided herein generally permit detection of the level of antigen that binds to the agent in the biological sample. Polynucleotide primers and probes may be used to detect the level of mRNA encoding a tumor protein, which is also indicative of the presence or absence of a cancer. In general, a prostate tumor sequence should be present at a level that is at least three fold higher in tumor tissue than in normal tissue There are a variety of assay formats known to those of ordinary skill in the art for using a binding agent to detect polypeptide markers in a sample. See, e.g., Harlow and Lane, Antibodies: A Laboratory Manual, Cold Spring Harbor Laboratory, 1988. In general, the presence or absence of a cancer in a patient may be determined by (a) contacting a biological sample obtained from a patient with a binding agent; (b) detecting in the sample a level of polypeptide that binds to the binding agent; and (c) comparing the level of polypeptide with a predetermined cut-off value.

In a preferred embodiment, the assay involves the use of binding agent immobilized on a solid support to bind to and remove the polypeptide from the remainder of the sample. The bound polypeptide may then be detected using a detection reagent that contains a reporter group and specifically binds to the binding agent/polypeptide complex. Such detection reagents may comprise, for example, a binding agent that specifically binds to the polypeptide or an antibody or other agent that specifically binds to the binding agent, such as an anti-immunoglobulin, protein G, protein A or a lectin. Alternatively, a competitive assay may be utilized, in which a polypeptide is labeled with a reporter group and allowed to bind to the immobilized binding agent after incubation of the binding agent with the sample. The extent to which components of the sample inhibit the binding of the labeled polypeptide to the binding agent is indicative of the reactivity of the sample with the immobilized binding agent. Suitable polypeptides for use within such assays include full length prostate tumor proteins and polypeptide portions thereof to which the binding agent binds, as described above.

The solid support may be any material known to those of ordinary skill in the art to which the tumor protein may be attached. For example, the solid support may be a test well in a microtiter plate or a nitrocellulose or other suitable membrane. Alternatively, the support may be a bead or disc, such as glass, fiberglass, latex or a plastic material such as polystyrene or polyvinylchloride. The support may also be a magnetic particle or a fiber optic sensor, such as those disclosed, for example, in U.S. Pat. No. 5,359,681. The binding agent may be immobilized on the solid support using a variety of techniques known to those of skill in the art, which are amply described in the patent and scientific literature. In the context of the present invention, the term "immobilization" refers to both noncovalent association, such as adsorption, and covalent attachment (which may be a direct linkage between the agent and functional groups on the support or may be a linkage by way of a cross-linking agent). Immobilization by adsorption to a well in a microtiter plate or to a membrane is preferred. In such cases, adsorption may be achieved by contacting the binding agent, in a suitable buffer, with the solid support for a suitable amount of time. The contact time varies with temperature, but is typically between about 1 hour and about 1 day. In general, contacting a well of a plastic microtiter plate (such as polystyrene or polyvinylchloride) with an amount of binding agent ranging from about 10 ng to about 10 μg, and preferably about 100 ng to about 1 μg, is sufficient to immobilize an adequate amount of binding agent.

Covalent attachment of binding agent to a solid support may generally be achieved by first reacting the support with a bifunctional reagent that will react with both the support and a functional group, such as a hydroxyl or amino group, on the binding agent. For example, the binding agent may be covalently attached to supports having an appropriate polymer coating using benzoquinone or by condensation of an aldehyde group on the support with an amine and an active hydrogen on the binding partner (see, e.g., Pierce Immunotechnology Catalog and Handbook, 1991, at A12–A13).

In certain embodiments, the assay is a two-antibody sandwich assay. This assay may be performed by first contacting an antibody that has been immobilized on a solid support, commonly the well of a microtiter plate, with the sample, such that polypeptides within the sample are allowed to bind to the immobilized antibody. Unbound sample is then removed from the immobilized polypeptide-antibody complexes and a detection reagent (preferably a second antibody capable of binding to a different site on the polypeptide) containing a reporter group is added. The amount of detection reagent that remains bound to the solid support is then determined using a method appropriate for the specific reporter group.

More specifically, once the antibody is immobilized on the support as described above, the remaining protein binding sites on the support are typically blocked. Any suitable blocking agent known to those of ordinary skill in the art, such as bovine serum albumin or Tween 20™ (Sigma Chemical Co., St. Louis, Mo.). The immobilized antibody is then incubated with the sample, and polypeptide is allowed to bind to the antibody. The sample may be diluted with a suitable diluent, such as phosphate-buffered saline (PBS) prior to incubation. In general, an appropriate contact time (i.e., incubation time) is a period of time that is sufficient to detect the presence of polypeptide within a sample obtained from an individual with prostate cancer. Preferably, the contact time is sufficient to achieve a level of binding that is at least about 95% of that achieved at equilibrium between bound and unbound polypeptide. Those of ordinary skill in the art will recognize that the time necessary to achieve equilibrium may be readily determined by assaying the level of binding that occurs over a period of time. At room temperature, an incubation time of about 30 minutes is generally sufficient.

Unbound sample may then be removed by washing the solid support with an appropriate buffer, such as PBS containing 0.1% Tween 20™. The second antibody, which contains a reporter group, may then be added to the solid support. Preferred reporter groups include those groups recited above.

The detection reagent is then incubated with the immobilized antibody-polypeptide complex for an amount of time sufficient to detect the bound polypeptide. An appropriate amount of time may generally be determined by assaying the level of binding that occurs over a period of time. Unbound detection reagent is then removed and bound detection reagent is detected using the reporter group. The method employed for detecting the reporter group depends upon the nature of the reporter group. For radioactive groups, scintillation counting or autoradiographic methods are generally appropriate. Spectroscopic methods may be used to detect dyes, luminescent groups and fluorescent groups. Biotin may be detected using avidin, coupled to a different reporter group (commonly a radioactive or fluorescent group or an enzyme). Enzyme reporter groups may generally be detected by the addition of substrate (generally for a specific period of time), followed by spectroscopic or other analysis of the reaction products.

To determine the presence or absence of a cancer, such as prostate cancer, the signal detected from the reporter group that remains bound to the solid support is generally compared to a signal that corresponds to a predetermined cut-off value. In one preferred embodiment, the cut-off value for the detection of a cancer is the average mean signal obtained when the immobilized antibody is incubated with samples from patients without the cancer. In general, a sample generating a signal that is three standard deviations above the predetermined cut-off value is considered positive for the cancer. In an alternate preferred embodiment, the cut-off value is determined using a Receiver Operator Curve, according to the method of Sackett et al., *Clinical Epidemiology: A Basic Science for Clinical Medicine*, Little Brown and Co., 1985, p. 106–7. Briefly, in this embodiment, the cut-off value may be determined from a plot of pairs of true positive rates (i.e., sensitivity) and false positive rates (100%-specificity) that correspond to each possible cut-off value for the diagnostic test result. The cut-off value on the plot that is the closest to the upper left-hand corner (i.e., the value that encloses the largest area) is the most accurate cut-off value, and a sample generating a signal that is higher than the cut-off value determined by this method may be considered positive. Alternatively, the cut-off value may be shifted to the left along the plot, to minimize the false positive rate, or to the right, to minimize the false negative rate. In general, a sample generating a signal that is higher than the cut-off value determined by this method is considered positive for a cancer.

In a related embodiment, the assay is performed in a flow-through or strip test format, wherein the binding agent is immobilized on a membrane, such as nitrocellulose. In the flow-through test, polypeptides within the sample bind to the immobilized binding agent as the sample passes through the membrane. A second, labeled binding agent then binds to the binding agent-polypeptide complex as a solution containing the second binding agent flows through the membrane. The detection of bound second binding agent may then be performed as described above. In the strip test format, one end of the membrane to which binding agent is bound is immersed in a solution containing the sample. The sample migrates along the membrane through a region containing second binding agent and to the area of immobilized binding agent. Concentration of second binding agent at the area of immobilized antibody indicates the presence of a cancer. Typically, the concentration of second binding agent at that site generates a pattern, such as a line, that can be read visually. The absence of such a pattern indicates a negative result. In general, the amount of binding agent immobilized on the membrane is selected to generate a visually discernible pattern when the biological sample contains a level of polypeptide that would be sufficient to generate a positive signal in the two-antibody sandwich assay, in the format discussed above. Preferred binding agents for use in such assays are antibodies and antigen-binding fragments thereof. Preferably, the amount of antibody immobilized on the membrane ranges from about 25 ng to about 1 μg, and more preferably from about 50 ng to about 500 ng. Such tests can typically be performed with a very small amount of biological sample.

Of course, numerous other assay protocols exist that are suitable for use with the tumor proteins or binding agents of the present invention. The above descriptions are intended to be exemplary only. For example, it will be apparent to those of ordinary skill in the art that the above protocols may be readily modified to use tumor polypeptides to detect antibodies that bind to such polypeptides in a biological sample. The detection of such tumor protein specific antibodies may correlate with the presence of a cancer.

A cancer may also, or alternatively, be detected based on the presence of T cells that specifically react with a tumor protein in a biological sample. Within certain methods, a biological sample comprising $CD4^+$ and/or $CD8^+$ T cells isolated from a patient is incubated with a tumor polypeptide, a polynucleotide encoding such a polypeptide and/or an APC that expresses at least an immunogenic portion of such a polypeptide, and the presence or absence of specific activation of the T cells is detected. Suitable biological samples include, but are not limited to, isolated T cells. For example, T cells may be isolated from a patient by routine techniques (such as by Ficoll/Hypaque density gradient centrifugation of peripheral blood lymphocytes). T cells may be incubated in vitro for 2–9 days (typically 4 days) at 37° C. with polypeptide (e.g., 5–25 $\mu$g/ml). It may be desirable to incubate another aliquot of a T cell sample in the absence of tumor polypeptide to serve as a control. For $CD4^+$ T cells, activation is preferably detected by evaluating proliferation of the T cells. For $CD8^+$ T cells, activation is preferably detected by evaluating cytolytic activity. A level of proliferation that is at least two fold greater and/or a level of cytolytic activity that is at least 20% greater than in disease-free patients indicates the presence of a cancer in the patient.

As noted above, a cancer may also, or alternatively, be detected based on the level of mRNA encoding a tumor protein in a biological sample. For example, at least two oligonucleotide primers may be employed in a polymerase chain reaction (PCR) based assay to amplify a portion of a tumor cDNA derived from a biological sample, wherein at least one of the oligonucleotide primers is specific for (i.e., hybridizes to) a polynucleotide encoding the tumor protein. The amplified cDNA is then separated and detected using techniques well known in the art, such as gel electrophoresis. Similarly, oligonucleotide probes that specifically hybridize to a polynucleotide encoding a tumor protein may be used in a hybridization assay to detect the presence of polynucleotide encoding the tumor protein in a biological sample.

To permit hybridization under assay conditions, oligonucleotide primers and probes should comprise an oligonucleotide sequence that has at least about 60%, preferably at least about 75% and more preferably at least about 90%, identity to a portion of a polynucleotide encoding a tumor protein of the invention that is at least 10 nucleotides, and preferably at least 20 nucleotides, in length. Preferably, oligonucleotide primers and/or probes hybridize to a polynucleotide encoding a polypeptide described herein under moderately stringent conditions, as defined above. Oligonucleotide primers and/or probes which may be usefully employed in the diagnostic methods described herein preferably are at least 10–40 nucleotides in length. In a preferred embodiment, the oligonucleotide primers comprise at least 10 contiguous nucleotides, more preferably at least 15 contiguous nucleotides, of a DNA molecule having a sequence as disclosed herein. Techniques for both PCR based assays and hybridization assays are well known in the art (see, for example, Mullis et al., *Cold Spring Harbor Symp. Quant. Biol.*, 51:263, 1987; Erlich ed., *PCR Technology*, Stockton Press, N.Y., 1989).

One preferred assay employs RT-PCR, in which PCR is applied in conjunction with reverse transcription. Typically, RNA is extracted from a biological sample, such as biopsy tissue, and is reverse transcribed to produce cDNA molecules. PCR amplification using at least one specific primer generates a cDNA molecule, which may be separated and visualized using, for example, gel electrophoresis. Amplification may be performed on biological samples taken from a test patient and from an individual who is not afflicted with a cancer. The amplification reaction may be performed on several dilutions of cDNA spanning two orders of magnitude. A two-fold or greater increase in expression in several dilutions of the test patient sample as compared to the same dilutions of the non-cancerous sample is typically considered positive.

In another embodiment, the compositions described herein may be used as markers for the progression of cancer. In this embodiment, assays as described above for the diagnosis of a cancer may be performed over time, and the change in the level of reactive polypeptide(s) or polynucleotide(s) evaluated. For example, the assays may be performed every 24–72 hours for a period of 6 months to 1 year, and thereafter performed as needed. In general, a cancer is progressing in those patients in whom the level of polypeptide or polynucleotide detected increases over time. In contrast, the cancer is not progressing when the level of reactive polypeptide or polynucleotide either remains constant or decreases with time.

Certain in vivo diagnostic assays may be performed directly on a tumor. One such assay involves contacting tumor cells with a binding agent. The bound binding agent may then be detected directly or indirectly via a reporter group. Such binding agents may also be used in histological applications. Alternatively, polynucleotide probes may be used within such applications.

As noted above, to improve sensitivity, multiple tumor protein markers may be assayed within a given sample. It will be apparent that binding agents specific for different proteins provided herein may be combined within a single assay. Further, multiple primers or probes may be used concurrently. The selection of tumor protein markers may be based on routine experiments to determine combinations that results in optimal sensitivity. In addition, or alternatively, assays for tumor proteins provided herein may be combined with assays for other known tumor antigens.

The present invention further provides kits for use within any of the above diagnostic methods. Such kits typically comprise two or more components necessary for performing a diagnostic assay. Components may be compounds, reagents, containers and/or equipment. For example, one container within a kit may contain a monoclonal antibody or fragment thereof that specifically binds to a tumor protein. Such antibodies or fragments may be provided attached to a support material, as described above. One or more additional containers may enclose elements, such as reagents or buffers, to be used in the assay. Such kits may also, or alternatively, contain a detection reagent as described above that contains a reporter group suitable for direct or indirect detection of antibody binding.

Alternatively, a kit may be designed to detect the level of mRNA encoding a tumor protein in a biological sample. Such kits generally comprise at least one oligonucleotide probe or primer, as described above, that hybridizes to a polynucleotide encoding a tumor protein. Such an oligonucleotide may be used, for example, within a PCR or hybridization assay. Additional components that may be present within such kits include a second oligonucleotide and/or a diagnostic reagent or container to facilitate the detection of a polynucleotide encoding a tumor protein.

The following Examples are offered by way of illustration and not by way of limitation.

EXAMPLES

Example 1

Isolation and Characterization of Prostate-specific Polypeptides

This Example describes the isolation of certain prostate-specific polypeptides from a prostate tumor cDNA library.

A human prostate tumor cDNA expression library was constructed from prostate tumor poly $A^+$ RNA using a Superscript Plasmid System for cDNA Synthesis and Plasmid Cloning kit (BRL Life Technologies, Gaithersburg, Md. 20897) following the manufacturer's protocol. Specifically, prostate tumor tissues were homogenized with polytron (Kinematica, Switzerland) and total RNA was extracted using Trizol reagent (BRL Life Technologies) as directed by the manufacturer. The poly $A^+$ RNA was then purified using a Qiagen oligotex spin column mRNA purification kit (Qiagen, Santa Clarita, Calif. 91355) according to the manufacturer's protocol. First-strand cDNA was synthesized using the NotI/Oligo-dT18 primer. Double-stranded cDNA was synthesized, ligated with EcoRI/BAXI adaptors (Invitrogen, San Diego, Calif.) and digested with NotI. Following size fractionation with Chroma Spin-1000 columns (Clontech, Palo Alto, Calif.), the cDNA was ligated into the EcoRI/NotI site of pCDNA3.1 (Invitrogen) and transformed into ElectroMax *E. coli* DH10B cells (BRL Life Technologies) by electroporation.

Using the same procedure, a normal human pancreas cDNA expression library was prepared from a pool of six tissue specimens (Clontech). The cDNA libraries were characterized by determining the number of independent colonies, the percentage of clones that carried insert, the average insert size and by sequence analysis. The prostate tumor library contained $1.64 \times 10^7$ independent colonies, with 70% of clones having an insert and the average insert size being 1745 base pairs. The normal pancreas cDNA library contained $3.3 \times 10^6$ independent colonies, with 69% of clones having inserts and the average insert size being 1120 base pairs. For both libraries, sequence analysis showed that the majority of clones had a full length cDNA sequence and were synthesized from mRNA, with minimal rRNA and mitochondrial DNA contamination.

cDNA library subtraction was performed using the above prostate tumor and normal pancreas cDNA libraries, as described by Hara et al. (*Blood*, 84:189–199, 1994) with some modifications. Specifically, a prostate tumor-specific subtracted cDNA library was generated as follows. Normal pancreas cDNA library (70 $\mu$g) was digested with EcoRI, NotI, and SfuI, followed by a filling-in reaction with DNA polymerase Klenow fragment. After phenol-chloroform extraction and ethanol precipitation, the DNA was dissolved in 100 $\mu$l of $H_2O$, heat-denatured and mixed with 100 $\mu$l (100 $\mu$g) of Photoprobe biotin (Vector Laboratories, Burlingame, Calif.). As recommended by the manufacturer, the resulting mixture was irradiated with a 270 W sunlamp on ice for 20 minutes. Additional Photoprobe biotin (50 $\mu$l) was added and the biotinylation reaction was repeated. After extraction with butanol five times, the DNA was ethanol-precipitated and dissolved in 23 $\mu$l $H_2O$ to form the driver DNA.

To form the tracer DNA, 10 $\mu$g prostate tumor cDNA library was digested with BamHI and XhoI, phenol chloroform extracted and passed through Chroma spin-400 columns (Clontech). Following ethanol precipitation, the tracer DNA was dissolved in 5 $\mu$l $H_2O$. Tracer DNA was mixed with 15 $\mu$l driver DNA and 20 $\mu$l of 2×hybridization buffer (1.5 M NaCl/10 mM EDTA/50 mM HEPES pH 7.5/0.2% sodium dodecyl sulfate), overlaid with mineral oil, and heat-denatured completely. The sample was immediately transferred into a 68° C. water bath and incubated for 20 hours (long hybridization [LH]). The reaction mixture was then subjected to a streptavidin treatment followed by phenol/chloroform extraction. This process was repeated three more times. Subtracted DNA was precipitated, dissolved in 12 $\mu$l $H_2O$, mixed with 8 $\mu$l driver DNA and 20 $\mu$l of 2×hybridization buffer, and subjected to a hybridization at 68° C. for 2 hours (short hybridization [SH]). After removal of biotinylated double-stranded DNA, subtracted cDNA was ligated into BamHI/XhoI site of chloramphenicol resistant pBCSK+ (Stratagene, La Jolla, Calif. 92037) and transformed into ElectroMax *E. coli* DH10B cells by electroporation to generate a prostate tumor specific subtracted cDNA library (referred to as "prostate subtraction 1").

To analyze the subtracted cDNA library, plasmid DNA was prepared from 100 independent clones, randomly picked from the subtracted prostate tumor specific library and grouped based on insert size. Representative cDNA clones were further characterized by DNA sequencing with a Perkin Elmer/Applied Biosystems Division Automated Sequencer Model 373A (Foster City, Calif.). Six cDNA clones, hereinafter referred to as F1-13, F1-12, F1-16, H1-1, H1-9 and H1-4, were shown to be abundant in the subtracted prostate-specific cDNA library. The determined 3' and 5' cDNA sequences for F1-12 are provided in SEQ ID NO: 2 and 3, respectively, with determined 3' cDNA sequences for F1-13, F1-16, H1-1, H1-9 and H1-4 being provided in SEQ ID NO: 1 and 4–7, respectively.

The cDNA sequences for the isolated clones were compared to known sequences in the gene bank using the EMBL and GenBank databases (release 96). Four of the prostate tumor cDNA clones, F1-13, F1-16, H1-1, and H1-4, were determined to encode the following previously identified proteins: prostate specific antigen (PSA), human glandular kallikrein, human tumor expression enhanced gene, and mitochondria cytochrome C oxidase subunit II. H1-9 was found to be identical to a previously identified human autonomously replicating sequence. No significant homologies to the cDNA sequence for F1-12 were found.

Subsequent studies led to the isolation of a full-length cDNA sequence for F1-12 (also referred to as P504S). This sequence is provided in SEQ ID NO: 107, with the corresponding predicted amino acid sequence being provided in SEQ ID NO: 108. cDNA splice variants of P504S are provided in SEQ ID NO: 600–605.

To clone less abundant prostate tumor specific genes, cDNA library subtraction was performed by subtracting the prostate tumor cDNA library described above with the normal pancreas cDNA library and with the three most abundant genes in the previously subtracted prostate tumor specific cDNA library: human glandular kallikrein, prostate specific antigen (PSA), and mitochondria cytochrome C oxidase subunit II. Specifically, 1 $\mu$g each of human glandular kallikrein, PSA and mitochondria cytochrome C oxidase subunit II cDNAs in pcDNA3.1 were added to the driver DNA and subtraction was performed as described above to provide a second subtracted cDNA library hereinafter referred to as the "subtracted prostate tumor specific cDNA library with spike".

Twenty-two cDNA clones were isolated from the subtracted prostate tumor specific cDNA library with spike. The determined 3' and 5' cDNA sequences for the clones referred to as J1-17, L1-12, N1-1862, J1-13, J1-19, J1-25, J1-24, K1-58, K1-63, L1-4 and L1-14 are provided in SEQ ID NOS: 8–9, 10–11, 12–13, 14–15, 16–17, 18–19, 20–21, 22–23, 24–25, 26–27 and 28–29, respectively. The determined 3' cDNA sequences for the clones referred to as J1-12, J1-16, J1-21, K1-48, K1-55, L1-2, L1-6, N1-1858, N1-1860, N1-1861, N1-1864 are provided in SEQ ID NOS: 30–40, respectively. Comparison of these sequences with those in the gene bank as described above, revealed no significant homologies to three of the five most abundant DNA species, (J1-17, L1-12 and N1-1862; SEQ ID NOS: 8–9, 10–11 and 12–13, respectively). Of the remaining two most abundant species, one (J1-12; SEQ ID NO:30) was found to be identical to the previously identified human pulmonary surfactant-associated protein, and the other (K1-48; SEQ ID NO:33) was determined to have some homology to *R. norvegicus* mRNA for 2-arylpropionyl-CoA epimerase. Of the 17 less abundant cDNA clones isolated from the subtracted prostate tumor specific cDNA library with spike, four (J1-16, K1-55, L1-6 and N1-1864; SEQ ID NOS:31, 34, 36 and 40, respectively) were found to be identical to previously identified sequences, two (J1-21 and N1-1860; SEQ ID NOS: 32 and 38, respectively) were found to show some homology to non-human sequences, and two (L1-2 and N1-1861; SEQ ID NOS: 35 and 39, respectively) were found to show some homology to known human sequences. No significant homologies were found to the polypeptides J1-13, J1-19, J1-24, J1-25, K1-58, K1-63, L1-4, L1-14 (SEQ ID NOS: 14–15, 16–17, 20–21, 18–19, 22–23, 24–25, 26–27, 28–29, respectively).

Subsequent studies led to the isolation of full length cDNA sequences for J1-17, L1-12 and N1-1862 (SEQ ID NOS: 109–111, respectively). The corresponding predicted amino acid sequences are provided in SEQ ID NOS: 112–114. L1-12 is also referred to as P501S. A cDNA splice variant of P501S is provided in SEQ ID NO: 606.

In a further experiment, four additional clones were identified by subtracting a prostate tumor cDNA library with normal prostate cDNA prepared from a pool of three normal prostate poly A+ RNA (referred to as "prostate subtraction 2"). The determined cDNA sequences for these clones, hereinafter referred to as U1-3064, U1-3065, V1-3692 and 1A-3905, are provided in SEQ ID NO: 69–72, respectively. Comparison of the determined sequences with those in the gene bank revealed no significant homologies to U1-3065.

A second subtraction with spike (referred to as "prostate subtraction spike 2") was performed by subtracting a prostate tumor specific cDNA library with spike with normal pancreas cDNA library and further spiked with PSA, J1-17, pulmonary surfactant-associated protein, mitochondrial DNA, cytochrome c oxidase subunit II, N1-1862, autonomously replicating sequence, L1-12 and tumor expression enhanced gene. Four additional clones, hereinafter referred to as V1-3686, R1-2330, 1B-3976 and V1-3679, were isolated. The determined cDNA sequences for these clones are provided in SEQ ID NO:73–76, respectively. Comparison of these sequences with those in the gene bank revealed no significant homologies to V1-3686 and R1-2330.

Further analysis of the three prostate subtractions described above (prostate subtraction 2, subtracted prostate tumor specific cDNA library with spike, and prostate subtraction spike 2) resulted in the identification of sixteen additional clones, referred to as 1G-4736, 1G-4738, 1G-4741, 1G-4744, 1G-4734, 1H-4774, 1H-4781, 1H-4785, 1H-4787, 1H-4796, 1I-4810, 1I-4811, 1J-4876, 1K-4884 and 1K-4896. The determined cDNA sequences for these clones are provided in SEQ ID NOS: 77–92, respectively. Comparison of these sequences with those in the gene bank as described above, revealed no significant homologies to 1G-4741, 1G-4734, 1I-4807, 1J-4876 and 1K-4896 (SEQ ID NOS: 79, 81, 87, 90 and 92, respectively). Further analysis of the isolated clones led to the determination of extended cDNA sequences for 1G-4736, 1G-4738, 1G-4741, 1G-4744, 1H-4774, 1H-4781, 1H-4785, 1H-4787, 1H-4796, 1-4807, 1J-4876, 1K-4884 and 1K-4896, provided in SEQ ID NOS: 179–188 and 191–193, respectively, and to the determination of additional partial cDNA sequences for 1I-4810 and 1I-4811, provided in SEQ ID NOS: 189 and 190, respectively.

Additional studies with prostate subtraction spike 2 resulted in the isolation of three more clones. Their sequences were determined as described above and compared to the most recent GenBank. All three clones were found to have homology to known genes, which are Cysteine-rich protein, KIAA0242, and KIAA0280 (SEQ ID NO: 317, 319, and 320, respectively). Further analysis of these clones by Synteni microarray (Synteni, Palo Alto, Calif.) demonstrated that all three clones were overexpressed in most prostate tumors and prostate BPH, as well as in the majority of normal prostate tissues tested, but low expression in all other normal tissues.

An additional subtraction was performed by subtracting a normal prostate cDNA library with normal pancreas cDNA (referred to as "prostate subtraction 3"). This led to the identification of six additional clones referred to as 1G-4761, 1G-4762, 1H-4766, 1H-4770, 1H-4771 and 1H-4772 (SEQ ID NOS: 93–98). Comparison of these sequences with those in the gene bank revealed no significant homologies to 1G-4761 and 1H-4771 (SEQ ID NOS: 93 and 97, respectively). Further analysis of the isolated clones led to the determination of extended cDNA sequences for 1G-4761, 1G-4762, 1H-4766 and 1H-4772 provided in SEQ ID NOS: 194–196 and 199, respectively, and to the determination of additional partial cDNA sequences for 1H-4770 and 1H-4771, provided in SEQ ID NOS: 197 and 198, respectively.

Subtraction of a prostate tumor cDNA library, prepared from a pool of polyA+ RNA from three prostate cancer patients, with a normal pancreas cDNA library (prostate subtraction 4) led to the identification of eight clones, referred to as 1D-4297, 1D-4309, 1D.1-4278, 1D-4288, 1D-4283, 1D-4304, 1D-4296 and 1D-4280 (SEQ ID NOS: 99–107). These sequences were compared to those in the gene bank as described above. No significant homologies were found to 1D-4283 and 1D-4304 (SEQ ID NOS: 103 and 104, respectively). Further analysis of the isolated clones led to the determination of extended cDNA sequences for 1D-4309, 1D.1-4278, 1D-4288, 1D-4283, 1D-4304, 1D-4296 and 1D-4280, provided in SEQ ID NOS: 200–206, respectively.

cDNA clones isolated in prostate subtraction 1 and prostate subtraction 2, described above, were colony PCR amplified and their mRNA expression levels in prostate tumor, normal prostate and in various other normal tissues were determined using microarray technology (Synteni, Palo Alto, Calif.). Briefly, the PCR amplification products were dotted onto slides in an array format, with each product occupying a unique location in the array. mRNA was extracted from the tissue sample to be tested, reverse transcribed, and fluorescent-labeled cDNA probes were generated. The microarrays were probed with the labeled cDNA probes, the slides scanned and fluorescence intensity was measured. This intensity correlates with the hybridization intensity. Two clones (referred to as P509S and P510S) were found to be over-expressed in prostate tumor and normal prostate and expressed at low levels in all other normal tissues tested (liver, pancreas, skin, bone marrow, brain, breast, adrenal gland, bladder, testes, salivary gland, large intestine, kidney, ovary, lung, spinal cord, skeletal muscle and colon). The determined cDNA sequences for P509S and P510S are provided in SEQ ID NO: 223 and 224, respectively. Comparison of these sequences with those in the gene bank as described above, revealed some homology to previously identified ESTs.

Additional, studies led to the isolation of the full-length cDNA sequence for P509S. This sequence is provided in SEQ ID NO: 332, with the corresponding predicted amino acid sequence being provided in SEQ ID NO: 339. Two variant full-length cDNA sequences for P510S are provided in SEQ ID NO: 535 and 536, with the corresponding predicted amino acid sequences being provided in SEQ ID NO: 537 and 538 respectively. Additional splice variants of P510S are provided in SEQ ID NO: 598 and 599.

The determined cDNA sequences for additional prostate-specific clones isolated during characterization of prostate specific cDNA libraries are provided in SEQ ID NO: 618–689, 691–697 and 709–772. Comparison of these sequences with those in the public databases revealed no significant homologies to any of these sequences.

Example 2

Determination of Tissue Specificity of Prostate-specific Polypertides

Using gene specific primers, mRNA expression levels for the representative prostate-specific polypeptides F1-16, H1-1, J1-17 (also referred to as P502S), L1-12 (also referred to as P501S), F1-12 (also referred to as P504S) and N1-1862 (also referred to as P503S) were examined in a variety of normal and tumor tissues using RT-PCR.

Briefly, total RNA was extracted from a variety of normal and tumor tissues using Trizol reagent as described above. First strand synthesis was carried out using 1–2 μg of total RNA with SuperScript II reverse transcriptase (BRL Life Technologies) at 42° C. for one hour. The cDNA was then amplified by PCR with gene-specific primers. To ensure the semi-quantitative nature of the RT-PCR, β-actin was used as an internal control for each of the tissues examined. First, serial dilutions of the first strand cDNAs were prepared and RT-PCR assays were performed using β-actin specific primers. A dilution was then chosen that enabled the linear range amplification of the β-actin template and which was sensitive enough to reflect the differences in the initial copy numbers. Using these conditions, the β-actin levels were determined for each reverse transcription reaction from each tissue. DNA contamination was minimized by DNase treatment and by assuring a negative PCR result when using first strand cDNA that was prepared without adding reverse transcriptase.

mRNA Expression levels were examined in four different types of tumor tissue (prostate tumor from 2 patients, breast tumor from 3 patients, colon tumor, lung tumor), and sixteen different normal tissues, including prostate, colon, kidney, liver, lung, ovary, pancreas, skeletal muscle, skin, stomach, testes, bone marrow and brain. F1-16 was found to be expressed at high levels in prostate tumor tissue, colon tumor and normal prostate, and at lower levels in normal liver, skin and testes, with expression being undetectable in the other tissues examined. H1-1 was found to be expressed at high levels in prostate tumor, lung tumor, breast tumor, normal prostate, normal colon and normal brain, at much lower levels in normal lung, pancreas, skeletal muscle, skin, small intestine, bone marrow, and was not detected in the other tissues tested. J1-17 (P502S) and L1-12 (P501S) appear to be specifically over-expressed in prostate, with both genes being expressed at high levels in prostate tumor and normal prostate but at low to undetectable levels in all the other tissues examined. N1-1862 (P503S) was found to be over-expressed in 60% of prostate tumors and detectable in normal colon and kidney. The RT-PCR results thus indicate that F1-16, H1-1, J1-17 (P502S), N1-1862 (P503S) and L1-12 (P501S) a either prostate specific or are expressed at significantly elevated levels in prostate.

Further RT-PCR studies showed that F1-12 (P504S) is over-expressed in 60% of prostate tumors, detectable in normal kidney but not detectable in all other tissues tested. Similarly, R1-2330 was shown to be over-expressed in 40% of prostate tumors, detectable in normal kidney and liver, but not detectable in all other tissues tested. U1-3064 was found to be over-expressed in 60% of prostate tumors, and also expressed in breast and colon tumors, but was not detectable in normal tissues.

RT-PCR characterization of R1-2330, U1-3064 and 1D-4279 showed that these three antigens are over-expressed in prostate and/or prostate tumors.

Northern analysis with four prostate tumors, two normal prostate samples, two BPH prostates, and normal colon, kidney, liver, lung, pancrease, skeletal muscle, brain, stomach, testes, small intestine and bone marrow, showed that L1-12 (P501S) is over-expressed in prostate tumors and normal prostate, while being undetectable in other normal tissues tested. J1-17 (P502S) was detected in two prostate tumors and not in the other tissues tested. N1-1862 (P503S) was found to be over-expressed in three prostate tumors and to be expressed in normal prostate, colon and kidney, but not in other tissues tested. F1-12 (P504S) was found to be highly expressed in two prostate tumors and to be undetectable in all other tissues tested.

The microarray technology described above was used to determine the expression levels of representative antigens described herein in prostate tumor, breast tumor and the following normal tissues: prostate, liver, pancreas, skin, bone marrow, brain, breast, adrenal gland, bladder, testes, salivary gland, large intestine, kidney, ovary, lung, spinal cord, skeletal muscle and colon. L1-12 (P501S) was found to be over-expressed in normal prostate and prostate tumor, with some expression being detected in normal skeletal muscle. Both J1-12 and F1-12 (P504S) were found to be over-expressed in prostate tumor, with expression being lower or undetectable in all other tissues tested. N1-1862 (P503S) was found to be expressed at high levels in prostate tumor and normal prostate, and at low levels in normal large intestine and normal colon, with expression being undetectable in all other tissues tested. R1-2330 was found to be over-expressed in prostate tumor and normal prostate, and to be expressed at lower levels in all other tissues tested. 1D-4279 was found to be over-expressed in prostate tumor and normal prostate, expressed at lower levels in normal spinal cord, and to be undetectable in all other tissues tested.

Further microarray analysis to specifically address the extent to which P501S (SEQ ID NO: 110) was expressed in breast tumor revealed moderate over-expression not only in breast tumor, but also in metastatic breast tumor (2/31), with negligible to low expression in normal tissues. This data suggests that P501S may be over-expressed in various breast tumors as well as in prostate tumors.

The expression levels of 32 ESTs (expressed sequence tags) described by Vasmatzis et al. (*Proc. Natl. Acad. Sci. USA* 95:300–304, 1998) in a variety of tumor and normal tissues were examined by microarray technology as described above. Two of these clones (referred to as P1000C and P1001C) were found to be over-expressed in prostate tumor and normal prostate, and expressed at low to undetectable levels in all other tissues tested (normal aorta, thymus, resting and activated PBMC, epithelial cells, spinal cord, adrenal gland, fetal tissues, skin, salivary gland, large intestine, bone marrow, liver, lung, dendritic cells, stomach, lymph nodes, brain, heart, small intestine, skeletal muscle, colon and kidney. The determined cDNA sequences for P1000C and P1001C are provided in SEQ ID NO: 384 and 472, respectively. The sequence of P1001C was found to show some homology to the previously isolated Human mRNA for JM27 protein. No significant homologies were found to the sequence of P1000C.

The expression of the polypeptide encoded by the full length cDNA sequence for F1-12 (also referred to as P504S; SEQ ID NO: 108) was investigated by immunohistochemical analysis. Rabbit-anti-P504S polyclonal antibodies were generated against the full length P504S protein by standard techniques. Subsequent isolation and characterization of the polyclonal antibodies were also performed by techniques well known in the art. Immunohistochemical analysis showed that the P504S polypeptide was expressed in 100% of prostate carcinoma samples tested (n=5).

The rabbit-anti-P504S polyclonal antibody did not appear to label benign prostate cells with the same cytoplasmic granular staining, but rather with light nuclear staining. Analysis of normal tissues revealed that the encoded polypeptide was found to be expressed in some, but not all normal human tissues. Positive cytoplasmic staining with rabbit-anti-P504S polyclonal antibody was found in normal human kidney, liver, brain, colon and lung-associated macrophages, whereas heart and bone marrow were negative.

This data indicates that the P504S polypeptide is present in prostate cancer tissues, and that there are qualitative and quantitative differences in the staining between benign prostatic hyperplasia tissues and prostate cancer tissues, suggesting that this polypeptide may be detected selectively in prostate tumors and therefore be useful in the diagnosis of prostate cancer.

Example 3

Isolation and Characterization of Prostate-specific Polypertides by PCR-Based Subtraction A cDNA subtraction library, containing cDNA from normal prostate subtracted with ten other normal tissue cDNAs (brain, heart, kidney, liver, lung, ovary, placenta, skeletal muscle, spleen and thymus) and then submitted to a first round of PCR amplification, was purchased from Clontech. This library was subjected to a second round of PCR amplification, following the manufacturer's protocol. The resulting cDNA fragments were subcloned into the vector pT7 Blue T-vector (Novagen, Madison, Wis.) and transformed into XL-1 Blue MRF' *E. coli* (Stratagene). DNA was isolated from independent clones and sequenced using a Perkin Elmer/Applied Biosystems Division Automated Sequencer Model 373A.

Fifty-nine positive clones were sequenced. Comparison of the DNA sequences of these clones with those in the gene bank, as described above, revealed no significant homologies to 25 of these clones, hereinafter referred to as P5, P8, P9, P18, P20, P30, P34, P36, P38, P39, P42, P49, P50, P53, P55, P60, P64, P65, P73, P75, P76, P79 and P84. The determined cDNA sequences for these clones are provided in SEQ ID NO: 41–45, 47–52 and 54–65, respectively. P29, P47, P68, P80 and P82 (SEQ ID NO: 46, 53 and 66–68, respectively) were found to show some degree of homology to previously identified DNA sequences. To the best of the inventors' knowledge, none of these sequences have been previously shown to be present in prostate.

Further studies employing the sequence of SEQ ID NO: 67 as a probe in standard full-length cloning methods, resulted in the isolation of three cDNA sequences which appear to be splice variants of P80 (also known as P704P). These sequences are provided in SEQ ID NO: 699–701.

Further studies using the PCR-based methodology described above resulted in the isolation of more than 180 additional clones, of which 23 clones were found to show no significant homologies to known sequences. The determined cDNA sequences for these clones are provided in SEQ ID NO: 115–123, 127, 131, 137, 145, 147–151, 153, 156–158 and 160. Twenty-three clones (SEQ ID NO: 124–126, 128–130, 132–136, 138–144, 146, 152, 154, 155 and 159) were found to show some homology to previously identified ESTs. An additional ten clones (SEQ ID NO: 161–170) were found to have some degree of homology to known genes. Larger cDNA clones containing the P20 sequence represent splice variants of a gene referred to as P703P. The determined DNA sequence for the variants referred to as DE1, DE13 and DE14 are provided in SEQ ID NOS: 171, 175 and 177, respectively, with the corresponding predicted amino acid sequences being provided in SEQ ID NO: 172, 176 and 178, respectively. The determined cDNA sequence for an extended spliced form of P703 is provided in SEQ ID NO: 225. The DNA sequences for the splice variants referred to as DE2 and DE6 are provided in SEQ ID NOS: 173 and 174, respectively.

mRNA Expression levels for representative clones in tumor tissues (prostate (n=5), breast (n=2), colon and lung) normal tissues (prostate (n=5), colon, kidney, liver, lung (n=2), ovary (n=2), skeletal muscle, skin, stomach, small intestine and brain), and activated and non-activated PBMC was determined by RT-PCR as described above. Expression was examined in one sample of each tissue type unless otherwise indicated.

P9 was found to be highly expressed in normal prostate and prostate tumor compared to all normal tissues tested except for normal colon which showed comparable expression. P20, a portion of the P703P gene, was found to be highly expressed in normal prostate and prostate tumor, compared to all twelve normal tissues tested. A modest increase in expression of P20 in breast tumor (n=2), colon tumor and lung tumor was seen compared to all normal tissues except lung (1 of 2). Increased expression of P18 was found in normal prostate, prostate tumor and breast tumor compared to other normal tissues except lung and stomach. A modest increase in expression of P5 was observed in normal prostate compared to most other normal tissues. However, some elevated expression was seen in normal lung and PBMC. Elevated expression of P5 was also observed in prostate tumors (2 of 5), breast tumor and one lung tumor sample. For P30, similar expression levels were seen in normal prostate and prostate tumor, compared to six of twelve other normal tissues tested. Increased expression was seen in breast tumors, one lung tumor sample and one colon tumor sample, and also in normal PBMC. P29 was found to be over-expressed in prostate tumor (5 of 5) and normal prostate (5 of 5) compared to the majority of normal tissues. However, substantial expression of P29 was observed in normal colon and normal lung (2 of 2). P80 was found to be over-expressed in prostate tumor (5 of 5) and normal prostate (5 of 5) compared to all other normal tissues tested, with increased expression also being seen in colon tumor.

Further studies resulted in the isolation of twelve additional clones, hereinafter referred to as 10-d8, 10-h10, 11-c8, 7-g6, 8-b5, 8-b6, 8-d4, 8-d9, 8-g3, 8-h11, 9-f12 and 9-f3. The determined DNA sequences for 10-d8, 10-h10, 11-c8, 8-d4, 8-d9, 8-h11, 9-f12 and 9-f3 are provided in SEQ ID NO: 207, 208, 209, 216, 217, 220, 221 and 222, respectively. The determined forward and reverse DNA sequences for 7-g6, 8-b5, 8-b6 and 8-g3 are provided in SEQ ID NO: 210 and 211; 212 and 213; 214 and 215; and 218 and 219, respectively. Comparison of these sequences with those in the gene bank revealed no significant homologies to the sequence of 9-f3. The clones 10-d8, 11-c8 and 8-h11 were found to show some homology to previously isolated ESTs, while 10-h10, 8-b5, 8-b6, 8-d4, 8-d9, 8-g3 and 9-f12 were found to show some homology to previously identified genes. Further characterization of 7-G6 and 8-G3 showed identity to the known genes PAP and PSA, respectively.

mRNA expression levels for these clones were determined using the micro-array technology described above. The clones 7-G6, 8-G3, 8-B5, 8-B6, 8-D4, 8-D9, 9-F3, 9-F12, 9-H3, 10-A2, 10-A4, 11-C9 and 11-F2 were found to be over-expressed in prosta tumor and normal prostate, with expression in other tissues tested being low or undetectable. Increased expression of 8-F 11 was seen in prostate tumor and normal prostate, bladder, skeletal muscle and colon. Increased expression of 10-H10 was seen in prostate tumor and normal prostate, bladder, lung, colon, brain and large intestine. Increased expression of 9-B1 was seen in prostate tumor, breast tumor, and normal prostate, salivary gland, large intestine and skin, with increased expression of 11-C8 being seen in prostate tumor, and normal prostate and large intestine.

An additional cDNA fragment derived from the PCR-based normal prostate subtraction, described above, was found to be prostate specific by both micro-array technology and RT-PCR. The determined cDNA sequence of this clone (referred to as 9-A11) is provided in SEQ ID NO: 226. Comparison of this sequence with those in the public databases revealed 99% identity to the known gene HOXB13.

Further studies led to the isolation of the clones 8-C6 and 8-H7. The determined cDNA sequences for these clones are provided in SEQ ID NO: 227 and 228, respectively. These sequences were found to show some homology to previously isolated ESTs.

PCR and hybridization-based methodologies were employed to obtain longer cDNA sequences for clone P20 (also referred to as P703P), yielding three additional cDNA fragments that progressively extend the 5' end of the gene. These fragments, referred to as P703PDE5, P703P6.26, and P703PX-23 (SEQ ID NO: 326, 328 and 330, with the predicted corresponding amino acid sequences being provided in SEQ ID NO: 327, 329 and 331, respectively) contain additional 5' sequence. P703PDE5 was recovered by screening of a cDNA library (#141-26) with a portion of P703P as a probe. P703P6.26 was recovered from a mixture of three prostate tumor cDNAs and P703PX__23 was recovered from cDNA library (#438-48). Together, the additional sequences include all of the putative mature serine protease along with part of the putative signal sequence. The full-length cDNA sequence for P703P is provided in SEQ ID NO: 524, with the corresponding amino acid sequence being provided in SEQ ID NO: 525.

Using computer algorithms, the following regions of P703P were predicted to represent potential HLA A2-binding CTL epitopes: amino acids 164–172 of SEQ ID NO: 525 (SEQ ID NO: 866); amino acids 160–168 of SEQ ID NO: 525 (SEQ ID NO: 867); amino acids 239–247 of SEQ ID NO: 525 (SEQ ID NO: 868); amino acids 118–126 of SEQ ID NO: 525 (SEQ ID NO: 869); amino acids 112–120 of SEQ ID NO: 525 (SEQ ID NO: 870); amino acids 155–164 of SEQ ID NO: 525 (SEQ ID NO: 871); amino acids 117–126 of SEQ ID NO: 525 (SEQ ID NO: 872); amino acids 164–173 of SEQ ID NO: 525 (SEQ ID NO: 873); amino acids 154–163 of SEQ ID NO: 525 (SEQ ID NO: 874); amino acids 163–172 of SEQ ID NO: 525 (SEQ ID NO: 875); amino acids 58–66 of SEQ ID NO: 525 (SEQ ID NO: 876); and amino acids 59–67 of SEQ ID NO: 525 (SEQ ID NO: 877).

P703P was found to show some homology to previously identified proteases, such as thrombin. The thrombin receptor has been shown to be preferentially expressed in highly metastatic breast carcinoma cells and breast carcinoma biopsy samples. Introduction of thrombin receptor antisense cDNA has been shown to inhibit the invasion of metastatic breast carcinoma cells in culture. Antibodies against thrombin receptor inhibit thrombin receptor activation and thrombin-induced platelet activation. Furthermore, peptides that resemble the receptor's tethered ligand domain inhibit platelet aggregation by thrombin. P703P may play a role in prostate cancer through a protease-activated receptor on the cancer cell or on stromal cells. The potential trypsin-like protease activity of P703P may either activate a protease-activated receptor on the cancer cell membrane to promote tumorgenesis or activate a protease-activated receptor on the adjacent cells (such as stromal cells) to secrete growth factors and/or proteases (such as matrix metalloproteinases) that could promote tumor angiogenesis, invasion and metastasis. P703P may thus promote tumor progression and/or metastasis through the activation of protease-activated receptor. Polypeptides and antibodies that block the P703P-receptor interaction may therefore be usefully employed in the treatment of prostate cancer.

To determine whether P703P expression increases with increased severity of Gleason grade, an indicator of tumor stage, quantitative PCR analysis was performed on prostate tumor samples with a range of Gleason scores from 5 to >8. The mean level of P703P expression increased with increasing Gleason score, indicating that P703P expression may correlate with increased disease severity.

Further studies using a PCR-based subtraction library of a prostate tumor pool subtracted against a pool of normal tissues (referred to as JP: PCR subtraction) resulted in the isolation of thirteen additional clones, seven of which did not share any significant homology to known GenBank sequences. The determined cDNA sequences for these seven clones (P711P, P712P, novel 23, P774P, P775P, P710P and P768P) are provided in SEQ ID NO: 307–311, 313 and 315, respectively. The remaining six clones (SEQ ID NO: 316 and 321–325) were shown to share some homology to known genes. By microarray analysis, all thirteen clones showed three or more fold over-expression in prostate tissues, including prostate tumors, BPH and normal prostate as compared to normal non-prostate tissues. Clones P711P, P712P, novel 23 and P768P showed over-expression in most prostate tumors and BPH tissues tested (n=29), and in the majority of normal prostate tissues (n=4), but background to low expression levels in all normal tissues. Clones P774P, P775P and P710P showed comparatively lower expression and expression in fewer prostate tumors and BPH samples, with negative to low expression in normal prostate.

Further studies led to the isolation of an extended cDNA sequence for P712P (SEQ ID NO: 552). The amino acid sequences encoded by 16 predicted open reading frames present within the sequence of SEQ ID NO: 552 are provided in SEQ ID NO: 553–568.

The full-length cDNA for P711P was obtained by employing the partial sequence of SEQ ID NO: 307 to screen a prostate cDNA library. Specifically, a directionally cloned prostate cDNA library was prepared using standard techniques. One million colonies of this library were plated onto LB/Amp plates. Nylon membrane filters were used to lift these colonies, and the cDNAs which were picked up by these filters were denatured and cross-linked to the filters by UV light. The P711P cDNA fragment of SEQ ID NO: 307 was radio-labeled and used to hybridize with these filters. Positive clones were selected, and cDNAs were prepared and sequenced using an automatic Perkin Elmer/Applied Biosystems sequencer. The determined full-length sequence of P711P is provided in SEQ ID NO: 382, with the corresponding predicted amino acid sequence being provided in SEQ ID NO: 383.

Using PCR and hybridization-based methodologies, additional cDNA sequence information was derived for two clones described above, 11-C9 and 9-F3, herein after referred to as P707P and P714P, respectively (SEQ ID NO: 333 and 334). After comparison with the most recent GenBank, P707P was found to be a splice variant of the known gene HoxB13. In contrast, no significant homologies to P714P were found. Further studies employing the sequence of SEQ ID NO: 334 as a probe in standard full-length cloning methods, resulted in an extended cDNA sequence for P714P. This sequence is provided in SEQ ID NO: 698. This sequence was found to show some homology to the gene that encodes human ribosomal L23A protein.

Clones 8-B3, P89, P98, P130 and P201 (as disclosed in U.S. patent application Ser. No. 09/020,956, filed Feb. 9, 1998) were found to be contained within one contiguous sequence, referred to as P705P (SEQ ID NO: 335, with the predicted amino acid sequence provided in SEQ ID NO: 336), which was determined to be a splice variant of the known gene NKX 3.1.

Further studies on P775P resulted in the isolation of four additional sequences (SEQ ID NO: 473–476) which are all splice variants of the P775P gene. The sequence of SEQ ID NO: 474 was found to contain two open reading frames (ORFs). The predicted amino acid sequences encoded by these ORFs are provided in SEQ ID NO: 477 and 478. The cDNA sequence of SEQ ID NO: 475 was found to contain an ORF which encodes the amino acid sequence of SEQ ID NO: 479. The cDNA sequence of SEQ ID NO: 473 was found to contain four ORFs. The predicted amino acid sequences encoded by these ORFs are provided in SEQ ID NO: 480–483. Additional splice variants of P775P are rovided in SEQ ID NO: 593–597.

Subsequent studies led to the identification of a genomic region on chromosome 22q 11.2, known as the Cat Eye Syndrome region, that contains the five prostate genes P704P, P712P, P774P, P775P and B305D. The relative location of each of these five genes within the genomic region is shown in FIG. 10. This region may therefore be associated with malignant tumors, and other potential tumor genes may be contained within this region. These studies also led to the identification of a potential open reading frame (ORF) for P775P (provided in SEQ ID NO: 533), which encodes the amino acid sequence of SEQ ID NO: 534.

Comparison of the clone of SEQ ID NO: 325 (referred to as P558S) with sequences in the GenBank and GeneSeq DNA databases showed that P558S is identical to the prostate-specific transglutaminase gene, which is known to have two forms. The full-length sequences for the two forms are provided in SEQ ID NO: 773 and 774, with the corresponding amino acid sequences being provided in SEQ ID NO: 775 and 776, respectively. The cDNA sequence of SEQ ID NO: 774 has a 15 pair base insert, resulting in a 5 amino acid insert in the corresponding amino acid sequence (SEQ ID NO: 776). This insert is not present in the sequence of SEQ ID NO: 773.

Example 4

Synthesis of Polypeptides

Polypeptides may be synthesized on a Perkin Elmer/Applied Biosystems 430A peptide synthesizer using FMOC chemistry with HPTU (O-Benzotriazole-N,N,N',N'-tetramethyluronium hexafluorophosphate) activation. A Gly-Cys-Gly sequence may be attached to the amino terminus of the peptide to provide a method of conjugation, binding to an immobilized surface, or labeling of the peptide. Cleavage of the peptides from the solid support may be carried out using the following cleavage mixture: trifluoroacetic acid:ethanedithiol:thioanisole:water:phenol (40:1:2:2:3). After cleaving for 2 hours, the peptides may be precipitated in cold methyl-t-butyl-ether. The peptide pellets may then be dissolved in water containing 0.1% trifluoroacetic acid (TFA) and lyophilized prior to purification by C18 reverse phase HPLC. A gradient of 0%–60% acetonitrile (containing 0.1% TFA) in water (containing 0.1% TFA) may be used to elute the peptides. Following lyophilization of the pure fractions, the peptides may be characterized using electrospray or other types of mass spectrometry and by amino acid analysis.

Example 5

Further Isolation and Characterization of Prostate-specific Polypeptides by PCR-based Subtraction A cDNA library generated from prostate primary tumor mRNA as described above was subtracted with cDNA from normal prostate. The subtraction was performed using a PCR-based protocol (Clontech), which was modified to generate larger fragments. Within this protocol, tester and driver double stranded cDNA were separately digested with five restriction enzymes that recognize six-nucleotide restriction sites (MluI, MscI, PvuII, SalI and StuI). This digestion resulted in an average cDNA size of 600 bp, rather than the average size of 300 bp that results from digestion with RsaI according to the Clontech protocol. This modification did not affect the subtraction efficiency. Two tester populations were then created with different adapters, and the driver library remained without adapters.

The tester and driver libraries were then hybridized using excess driver cDNA. In the first hybridization step, driver was separately hybridized with each of the two tester cDNA populations. This resulted in populations of (a) unhybridized tester cDNAs, (b) tester cDNAs hybridized to other tester cDNAs, (c) tester cDNAs hybridized to driver cDNAs and (d) unhybridized driver cDNAs. The two separate hybridization reactions were then combined, and rehybridized in the presence of additional denatured driver cDNA. Following this second hybridization, in addition to populations (a) through (d), a fifth population (e) was generated in which tester cDNA with one adapter hybridized to tester cDNA with the second adapter. Accordingly, the second hybridization step resulted in enrichment of differentially expressed sequences which could be used as templates for PCR amplification with adaptor-specific primers.

The ends were then filled in, and PCR amplification was performed using adaptor-specific primers. Only population (e), which contained tester cDNA that did not hybridize to driver cDNA, was amplified exponentially. A second PCR amplification step was then performed, to reduce background and further enrich differentially expressed sequences.

This PCR-based subtraction technique normalizes differentially expressed cDNAs so that rare transcripts that are overexpressed in prostate tumor tissue may be recoverable. Such transcripts would be difficult to recover by traditional subtraction methods.

In addition to genes known to be overexpressed in prostate tumor, seventy-seven further clones were identified. Sequences of these partial cDNAs are provided in SEQ ID NO: 29 to 305. Most of these clones had no significant homology to database sequences. Exceptions were JPTPN23 (SEQ ID NO: 231; similarity to pig valosin-containing protein), JPTPN30 (SEQ ID NO: 234; similarity to rat mRNA for proteasome subunit), JPTPN45 (SEQ ID NO: 243; similarity to rat *norvegicus* cytosolic NADP-dependent isocitrate dehydrogenase), JPTPN46 (SEQ ID NO: 244; similarity to human subclone H8 4 d4 DNA sequence), JP1D6 (SEQ ID NO: 265; similarity to *G. gallus* dynein light chain-A), JP8D6 (SEQ ID NO: 288; similarity to human BAC clone RG016J04), JP8F5 (SEQ ID NO: 289; similarity to human subclone H8 3 b5 DNA sequence), and JP8E9 (SEQ ID NO: 299; similarity to human Alu sequence).

Additional studies using the PCR-based subtraction library consisting of a prostate tumor pool subtracted against a normal prostate pool (referred to as PT-PN PCR subtraction) yielded three additional clones. Comparison of the cDNA sequences of these clones with the most recent release of GenBank revealed no significant homologies to the two clones referred to as P715P and P767P (SEQ ID NO: 312 and 314). The remaining clone was found to show some homology to the known gene KIAA0056 (SEQ ID NO: 318). Using microarray analysis to measure mRNA expression levels in various tissues, all three clones were found to be over-expressed in prostate tumors and BPH tissues. Specifically, clone P715P was over-expressed in most prostate tumors and BPH tissues by a factor of three or greater, with elevated expression seen in the majority of normal prostate samples and in fetal tissue, but negative to low expression in all other normal tissues. Clone P767P was over-expressed in several prostate tumors and BPH tissues, with moderate expression levels in half of the normal prostate samples, and background to low expression in all other normal tissues tested.

Further analysis, by microarray as described above, of the PT-PN PCR subtraction library and of a DNA subtraction library containing cDNA from prostate tumor subtracted with a pool of normal tissue cDNAs, led to the isolation of 27 additional clones (SEQ ID NO: 340–365 and 381) which were determined to be over-expressed in prostate tumor. The clones of SEQ ID NO: 341, 342, 345, 347, 348, 349, 351, 355–359, 361, 362 and 364 were also found to be expressed in normal prostate. Expression of all 26 clones in a variety of normal tissues was found to be low or undetectable, with the exception of P544S (SEQ ID NO: 356) which was found to be expressed in small intestine. Of the 26 clones, 11 (SEQ ID NO: 340–349 and 362) were found to show some homology to previously identified sequences. No significant homologies were found to the clones of SEQ ID NO: 350, 351, 353–361, and 363–365.

Comparison of the sequence of SEQ ID NO: 362 with sequences in the GenBank and GeneSeq DNA databases showed that this clone (referred to as P788P) is identical to GeneSeq Accession No. X27262, which encodes a protein found in the GeneSeq protein Accession No. Y00931. The full length cDNA sequence of P788P is shown in FIG. 12A (SEQ ID NO: 777), with the corresponding predicted amino acid being shown in FIG. 12B (SEQ ID NO: 778). Subsequently, a full-length cDNA sequence for P788P that contains polymorphisms not found in the sequence of SEQ ID NO: 779, was cloned multiple times by PCR amplification from cDNA prepared from several RNA templates from three individuals. This determined cDNA sequence of this polymorphic variant of P788P is provided in SEQ ID NO: 779, with the corresponding amino acid sequence being provided in SEQ ID NO: 780. The sequence of SEQ ID NO: 780 differs from that of SEQ ID NO: 778 by six amino acid residues. The P788P protein has 7 potential transmembrane domains at the C-terminal portion and is predicted to be a plasma membrane protein with an extracellular N-terminal region.

Further studies on the clone of SEQ ID NO: 352 (referred to as P790P) led to the isolation of the full-length cDNA sequence of SEQ ID NO: 526. The corresponding predicted amino acid is provided in SEQ ID NO: 527. Data from two quantitative PCR experiments indicated that P790P is over-expressed in 11/15 tested prostate tumor samples and is expressed at low levels in spinal cord, with no expression being seen in all other normal samples tested. Data from further PCR experiments and microarray experiments showed over-expression in normal prostate and prostate tumor with little or no expression in other tissues tested. P790P was subsequently found to show significant homology to a previously identified G-protein coupled prostate tissue receptor.

Additional studies on the clone of SEQ ID NO: 354 (referred to as P776P) led to the isolation of an extended cDNA sequence, provided in SEQ ID NO: 569. The determined cDNA sequences of three additional splice variants of P776P are provided in SEQ ID NO: 570–572. The amino acid sequences encoded by two predicted open reading frames (ORFs) contained within SEQ ID NO: 570, one predicted ORF contained within SEQ ID NO: 571, and 11 predicted ORFs contained within SEQ ID NO: 569, are provided in SEQ ID NO: 573–586, respectively. Further studies led to the isolation of the full-length sequence for the clone of SEQ ID NO: 570 (provided in SEQ ID NO: 880). Full-length cloning efforts on the clone of SEQ ID NO: 571 led to the isolation of two sequences (provided in SEQ ID NO: 881 and 882), representing a single clone, that are identical with the exception of a polymorphic insertion/deletion at position 1293. Specifically, the clone of SEQ ID NO: 882 (referred to as clone F1) has a C at position 1293.

The clone of SEQ ID NO: 881 (referred to as clone F2) has a single base pair deletion at position 1293. The predicted amino acid sequences encoded by 5 open reading frames located within SEQ ID NO: 880 are provided in SEQ ID NO: 883–887, with the predicted amino acid sequences encoded by the clone of SEQ ID NO: 881 and 882 being provided in SEQ ID NO: 888–893.

Comparison of the cDNA sequences for the clones P767P (SEQ ID NO: 314) and P777P (SEQ ID NO: 350) with sequences in the GenBank human EST database showed that the two clones matched many EST sequences in common, suggesting that P767P and P777P may represent the same gene. A DNA consensus sequence derived from a DNA sequence alignment of P767P, P777P and multiple EST clones is provided in SEQ ID NO: 587. The amino acid sequences encoded by three putative ORFs located within SEQ ID NO: 587 are provided in SEQ ID NO: 588–590.

The clone of SEQ ID NO: 342 (referred to as P789P) was found to show homology to a previously identified gene. The full length cDNA sequence for P789P and the corresponding amino acid sequence are provided in SEQ ID NO: 878 and 879, respectively.

Example 6

Peptide Priming of Mice and Propagation of CTL Lines 6.1. This Example illustrates the preparation of a CTL cell line specific for cells expressing the P502S gene.

Mice expressing the transgene for human HLA A2Kb (provided by Dr L. Sherman, The Scripps Research Institute, La Jolla, Calif.) were immunized with P2S#12 peptide (VLGWVAEL; SEQ ID NO: 306), which is derived from the P502S gene (also referred to herein as J1-17, SEQ ID NO: 8), as described by Theobald et al., *Proc. Natl. Acad. Sci. USA* 92:11993–11997, 1995 with the following modifications. Mice were immunized with 100 μg of P2S#12 and 120 μg of an I-A$^b$ binding peptide derived from hepatitis B Virus protein emulsified in incomplete Freund's adjuvant. Three weeks later these mice were sacrificed and using a nylon mesh single cell suspensions prepared. Cells were then resuspended at 6×10$^6$ cells/ml in complete media (RPMI-1640; Gibco BRL, Gaithersburg, Md.) containing 10% FCS, 2 mM Glutamine (Gibco BRL), sodium pyruvate (Gibco BRL), non-essential amino acids (Gibco BRL), 2×10$^{-5}$ M 2-mercaptoethanol, 50 U/ml penicillin and streptomycin, and cultured in the presence of irradiated (3000 rads) P2S#12-pulsed (5 mg/ml P2S#12 and 10 mg/ml β2-microglobulin) LPS blasts (A2 transgenic spleens cells cultured in the presence of 7 μg/ml dextran sulfate and 25 μg/ml LPS for 3 days). Six days later, cells (5×10$^5$/ml) were restimulated with 2.5×10$^6$/ml peptide pulsed irradiated (20,000 rads) EL4A2Kb cells (Sherman et al, *Science* 258:815–5 818, 1992) and 3×10$^6$/ml A2 transgenic spleen feeder cells. Cells were cultured in the presence of 20 U/ml IL-2. Cells continued to be restimulated on a weekly basis as described, in preparation for cloning the line.

Figure 1:
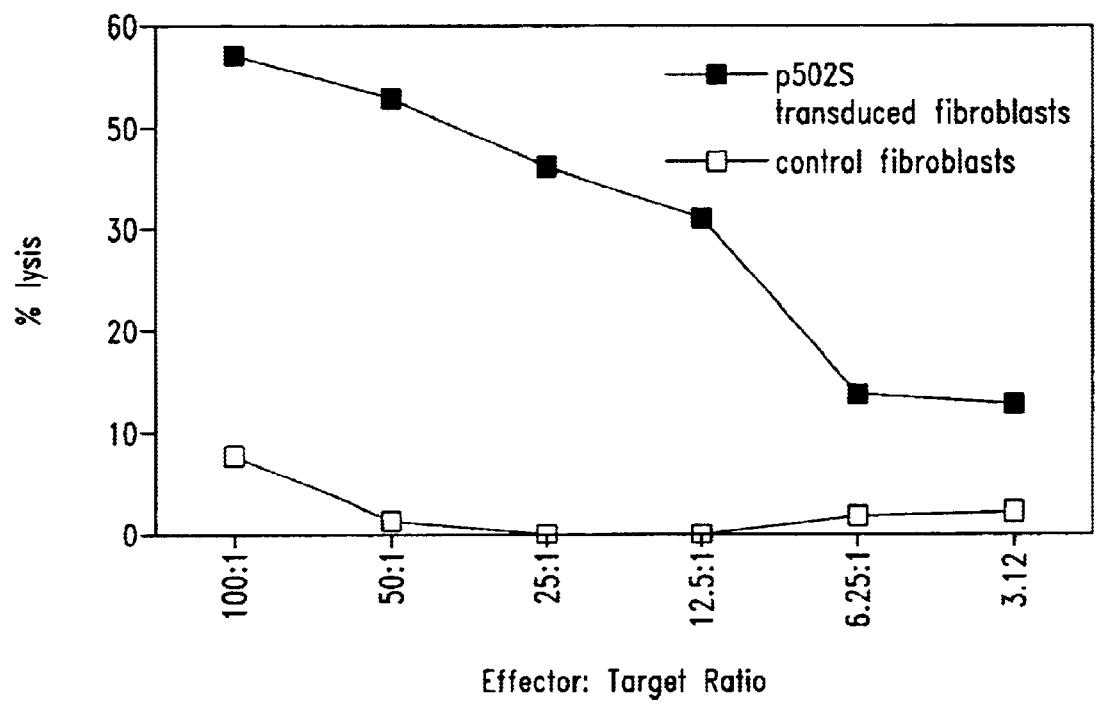

P2S#12 line was cloned by limiting dilution analysis with peptide pulsed EL4 A2Kb tumor cells (1×10$^4$ cells/well) as stimulators and A2 transgenic spleen cells as feeders (5×10$^5$ cells/well) grown in the presence of 30 U/ml IL-2. On day 14, cells were restimulated as before. On day 21, clones that were growing were isolated and maintained in culture. Several of these clones demonstrated significantly higher reactivity (lysis) against human fibroblasts (HLA A2Kb expressing) transduced with P502S than against control fibroblasts. An example is presented in FIG. 1.

This data indicates that P2S #12 represents a naturally processed epitope of the P502S protein that is expressed in the context of the human HLA A2Kb molecule.

6.2. This Example illustrates the preparation of murine CTL lines and CTL clones specific for cells expressing the P501S gene.

Figure 3:
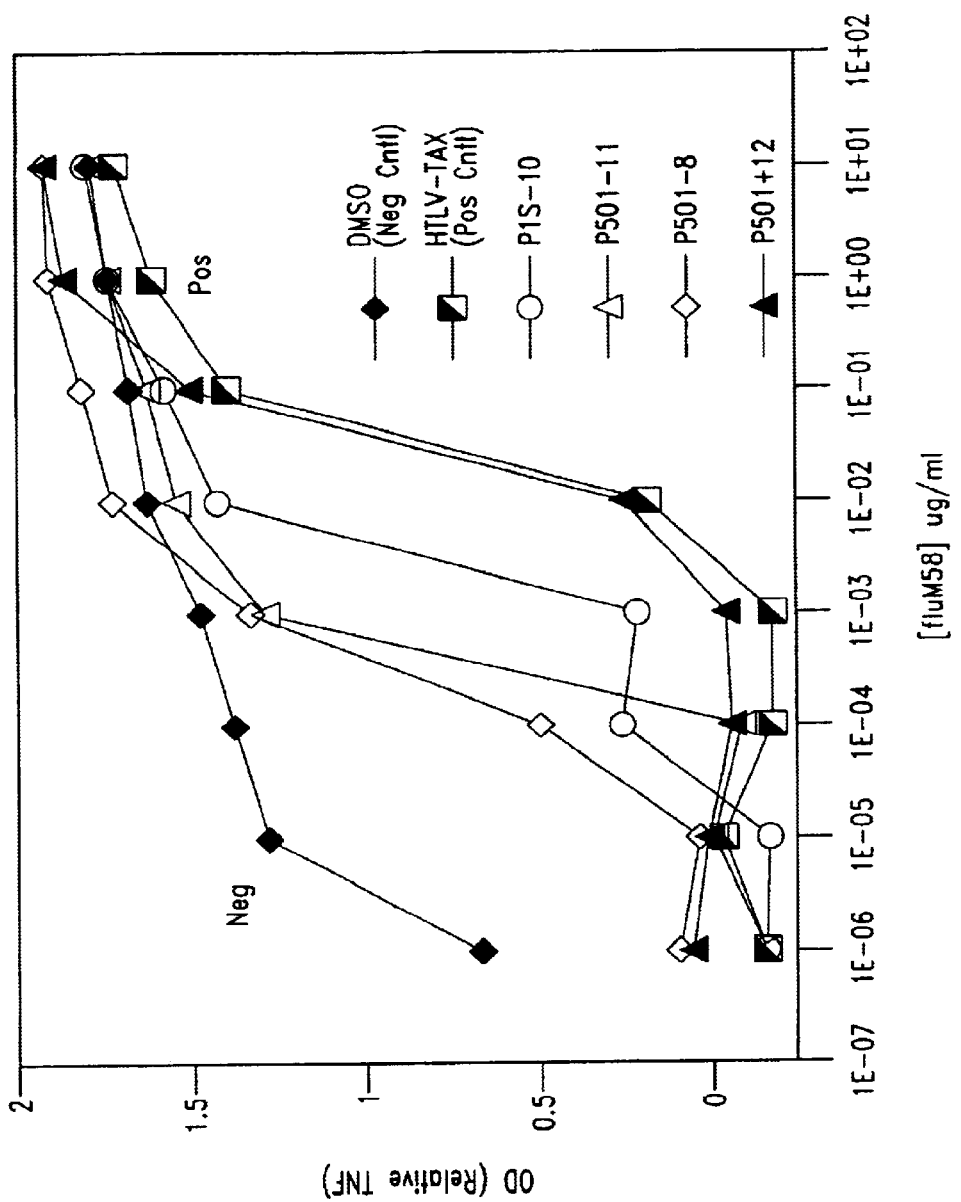

This series of experiments were performed similarly to that described above. Mice were immunized with the P1S#10 peptide (SEQ ID NO: 337), which is derived from the P501S gene (also referred to herein as L1-12, SEQ ID NO: 110). The P1S#10 peptide was derived by analysis of the predicted polypeptide sequence for P501S for potential HLA-A2 binding sequences as defined by published HLA-A2 binding motifs (Parker, K C, et al, *J. Immunol.*, 152:163, 1994). P1S#10 peptide was synthesized as described in Example 4, and empirically tested for HLA-A2 binding using a T cell based competition assay. Predicted A2 binding peptides were tested for their ability to compete HLA-A2 specific peptide presentation to an HLA-A2 restricted CTL clone (D150M58), which is specific for the HLA-A2 binding influenza matrix peptide fluM58. D150M58 CTL secretes TNF in response to self-presentation of peptide fluM58. In the competition assay, test peptides at 100–200 μg/ml were added to cultures of D150M58 CTL in order to bind HLA-A2 on the CTL. After thirty minutes, CTL cultured with test peptides, or control peptides, were tested for their antigen dose response to the fluM58 peptide in a standard TNF bioassay. As shown in FIG. 3, peptide P1S#10 competes HLA-A2 restricted presentation of fluM58, demonstrating that peptide P1S#10 binds HLA-A2.

Figure 4:
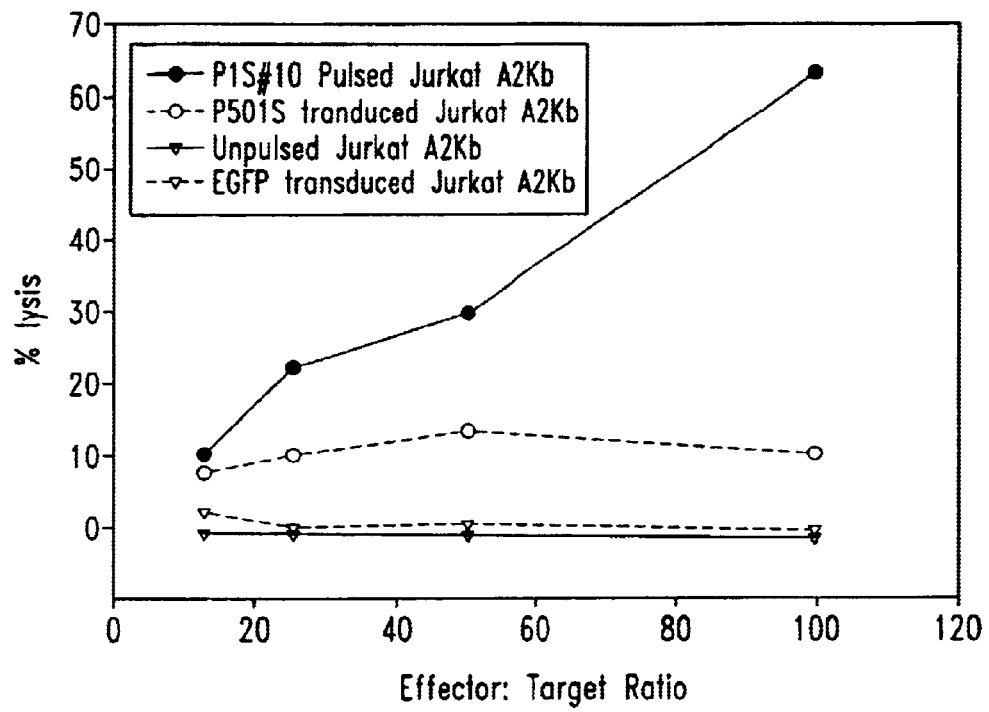
FIG. 4 illustrates the ability of T cell lines generated from P1S#10 immunized mice to specifically lyse P1S#10-pulsed Jurkat A2Kb targets and P501S-transduced Jurkat A2Kb targets, as compared to EGFP-transduced Jurkat A2Kb. The percent lysis is shown as a series of effector to target ratios, as indicated.

Mice expressing the transgene for human HLA A2Kb were immunized as described by Theobald et al. (*Proc. Natl. Acad. Sci. USA* 92:11993–11997, 1995) with the following modifications. Mice were immunized with 62.5 μg of P1S #10 and 120 μg of an I-A$^b$ binding peptide derived from Hepatitis B Virus protein emulsified in incomplete Freund's adjuvant. Three weeks later these mice were sacrificed and single cell suspensions prepared using a nylon mesh. Cells were then resuspended at 6×10$^6$ cells/ml in complete media (as described above) and cultured in the presence of irradiated (3000 rads) P1S#10-pulsed (2 μg/ml P1S#10 and 10 mg/ml β2-microglobulin) LPS blasts (A2 transgenic spleens cells cultured in the presence of 7 μg/ml dextran sulfate and 25 μg/ml LPS for 3 days). Six days later cells (5×10$^5$/ml) were restimulated with 2.5×10$^6$/ml peptide-pulsed irradiated (20,000 rads) EL4A2Kb cells, as described above, and 3×10$^6$/ml A2 transgenic spleen feeder cells. Cells were cultured in the presence of 20 U/ml IL-2. Cells were restimulated on a weekly basis in preparation for cloning. After three rounds of in vitro stimulations, one line was generated that recognized P1S#10-pulsed Jurkat A2Kb targets and P501S-transduced Jurkat targets as shown in FIG. 4.

Figure 5:
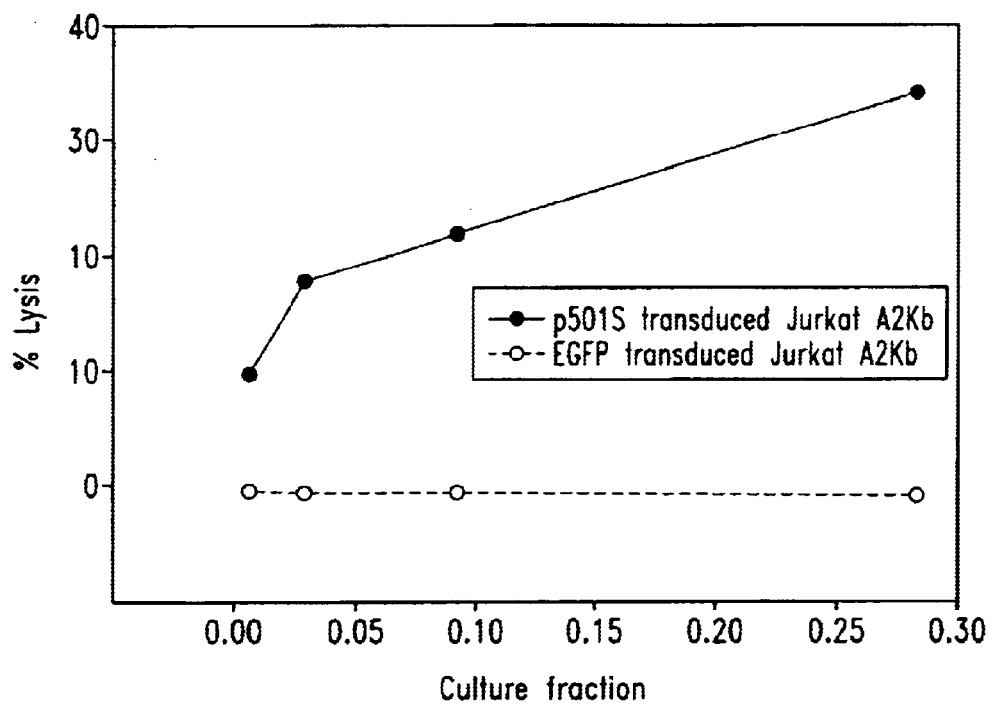
FIG. 5 illustrates the ability of a T cell clone to recognize and specifically lyse Jurkat A2Kb cells expressing the representative prostate-specific polypeptide P501S, thereby demonstrating that the P1S#10 peptide may be a naturally processed epitope of the P501S polypeptide.

A P1S#10-specific CTL line was cloned by limiting dilution analysis with peptide pulsed EL4 A2Kb tumor cells (1×10$^4$ cells/well) as stimulators and A2 transgenic spleen cells as feeders (5×10$^5$ cells/well) grown in the presence of 30 U/ml IL-2. On day 14, cells were restimulated as before. On day 21, viable clones were isolated and maintained in culture. As shown in FIG. 5, five of these clones demonstrated specific cytolytic reactivity against P501S-transduced Jurkat A2Kb targets. This data indicates that P1S#10 represents a naturally processed epitope of the P501S protein that is expressed in the context of the human HLA-A2.1 molecule.

Example 7

Priming of CTL IN VIVO Using Naked DNA Immunization with a Prostate Antigen The prostate-specific antigen L1-12, as described above, is also referred to as P501S. HLA A2Kb Tg mice (provided by Dr L. Sherman, The Scripps Research Institute, La Jolla, Calif.) were immunized with 100 μg P501S in the vector VR1012 either intramuscularly or intradermally. The mice were immunized three times, with a two week interval between immunizations. Two weeks after the last immunization, immune spleen cells were cultured with Jurkat A2Kb-P501S transduced stimulator cells. CTL lines were stimulated weekly. After two weeks of in vitro stimulation, CTL activity was assessed against P501S transduced targets. Two out of 8 mice developed strong anti-P501S CTL responses. These results demonstrate that P501S contains at least one naturally processed HLA-A2-restricted CTL epitope.

Example 8

Ability of Human T Cells to Recognize Prostate-specific Polypeptides

This Example illustrates the ability of T cells specific for a prostate tumor polypeptide to recognize human tumor.

Figure 2A:
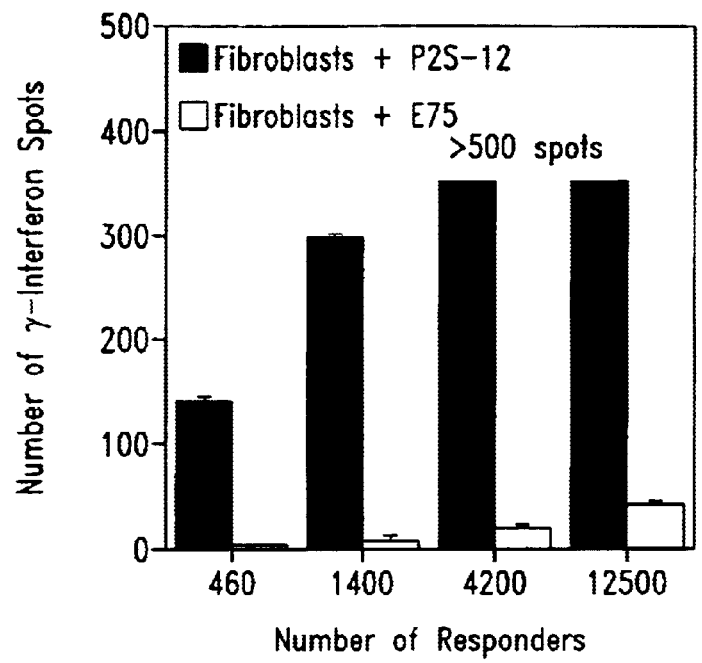
Figure 2B:
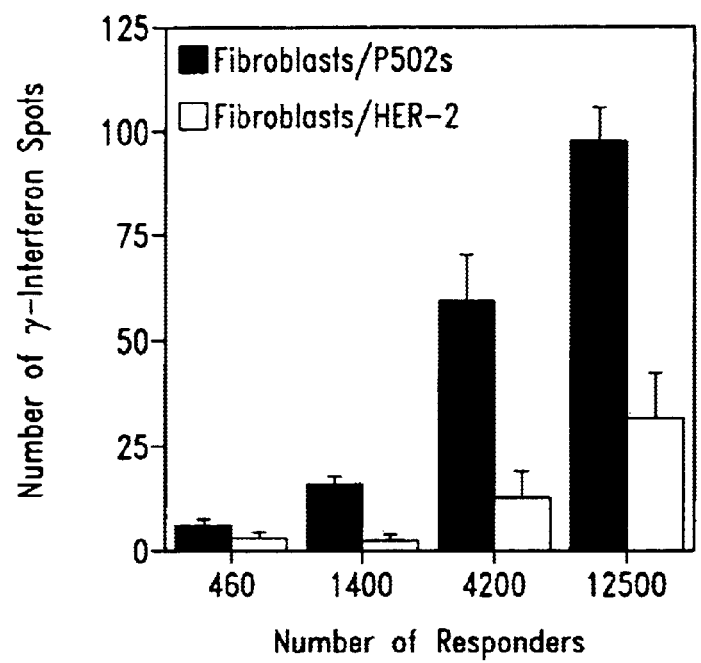

Human CD8+ T cells were primed in vitro to the P2S-12 peptide (SEQ ID NO: 306) derived from P502S (also referred to as J1-17) using dendritic cells according to the protocol of Van Tsai et al. (*Critical Reviews in Immunology* 18:65–75, 1998). The resulting CD8+ T cell microcultures were tested for their ability to recognize the P2S-12 peptide presented by autologous fibroblasts or fibroblasts which were transduced to express the P502S gene in a γ-interferon ELISPOT assay (see Lalvani et al., *J. Exp. Med.* 186:859–865, 1997). Briefly, titrating numbers of T cells were assayed in duplicate on $10^4$ fibroblasts in the presence of 3 μg/ml human $β_2$-microglobulin and 1 μg/ml P2S-12 peptide or control E75 peptide. In addition, T cells were simultaneously assayed on autologous fibroblasts transduced with the P502S gene or as a control, fibroblasts transduced with HER-2/neu. Prior to the assay, the fibroblasts were treated with 10 ng/ml γ-interferon for 48 hours to upregulate class I MHC expression. One of the microcultures (#5) demonstrated strong recognition of both peptide pulsed fibroblasts as well as transduced fibroblasts in a γ-interferon ELISPOT assay. FIG. 2A demonstrates that there was a strong increase in the number of γ-interferon spots with increasing numbers of T cells on fibroblasts pulsed with the P2S-12 peptide (solid bars) but not with the control E75 peptide (open bars). This shows the ability of these T cells to specifically recognize the P2S-12 peptide. As shown in FIG. 2B, this microculture also demonstrated an increase in the number of y-interferon spots with increasing numbers of T cells on fibroblasts transduced to express the P502S gene but not the HER-2/neu gene. These results provide additional confirmatory evidence that the P2S-12 peptide is a naturally processed epitope of the P502S protein. Furthermore, this also demonstrates that there exists in the human T cell repertoire, high affinity T cells which are capable of recognizing this epitope. These T cells should also be capable of recognizing human tumors which express the P502S gene.

Example 9

Elicitation of Prostate Antigen-specific CTL Responses in Human Blood

This Example illustrates the ability of a prostate-specific antigen to elicit a CTL response in blood of normal humans.

Autologous dendritic cells (DC) were differentiated from monocyte cultures derived from PBMC of normal donors by growth for five days in RPMI medium containing 10% human serum, 50 ng/ml GMCSF and 30 ng/ml IL-4. Following culture, DC were infected overnight with recombinant P501S-expressing vaccinia virus at an M.O.I. of 5 and matured for 8 hours by the addition of 2 micrograms/ml CD40 ligand. Virus was inactivated by UV irradiation, CD8+ cells were isolated by positive selection using magnetic beads, and priming cultures were initiated in 24-well plates. Following five stimulation cycles using autologous fibroblasts retrovirally transduced to express P501S and CD80, CD8+ lines were identified that specifically produced interferon-gamma when stimulated with autologous P501S-transduced fibroblasts. The P501S-specific activity of cell line 3A-1 could be maintained following additional stimulation cycles on autologous B-LCL transduced with P501S. Line 3A-1 was shown to specifically recognize autologous B-LCL transduced to express P501S, but not EGFP-transduced autologous B-LCL, as measured by cytotoxicity assays ($^{51}$Cr release) and interferon-gamma production (Interferon-gamma Elispot; see above and Lalvani et al., *J. Exp. Med.* 186:859–865, 1997). The results of these assays are presented in FIGS. 6A and 6B.

Example 10

Identification of a Naturally Processed CTL Epitope Contained Within the Prostate-spacific Antigen P703P The 9-mer peptide p5 (SEQ ID NO: 338) was derived from the P703P antigen (also referred to as P20). The p5 peptide is immunogenic in human HLA-A2 donors and is a naturally processed epitope. Antigen specific human CD8+ T cells can be primed following repeated in vitro stimulations with monocytes pulsed with p5 peptide. These CTL specifically recognize p5-pulsed and P703P-transduced target cells in both ELISPOT (as described above) and chromium release assays. Additionally, immunization of HLA-A2Kb transgenic mice with p5 leads to the generation of CTL lines which recognize a variety of HLA-A2Kb or HLA-A2 transduced target cells expressing P703P.

Initial studies demonstrating that p5 is a naturally processed epitope were done using HLA-A2Kb transgenic mice. HLA-A2Kb transgenic mice were immunized subcutaneously in the footpad with 100 μg of p5 peptide together with 140 μg of hepatitis B virus core peptide (a Th peptide) in Freund's incomplete adjuvant. Three weeks post immunization, spleen cells from immunized mice were stimulated in vitro with peptide-pulsed LPS blasts. CTL activity was assessed by chromium release assay five days after primary in vitro stimulation. Retrovirally transduced cells expressing the control antigen P703P and HLA-A2Kb were used as targets. CTL lines that specifically recognized both p5-pulsed targets as well as P703P-expressing targets were identified.

Human in vitro priming experiments demonstrated that the p5 peptide is immunogenic in humans. Dendritic cells (DC) were differentiated from monocyte cultures derived from PBMC of normal human donors by culturing for five days in RPMI medium containing 10% human serum, 50 ng/ml human GM-CSF and 30 ng/ml human IL-4. Following culture, the DC were pulsed with 1 ug/ml p5 peptide and cultured with CD8+ T cell enriched PBMC. CTL lines were restimulated on a weekly basis with p5-pulsed monocytes. Five to six weeks after initiation of the CTL cultures, CTL recognition of p5-pulsed target cells was demonstrated. CTL were additionally shown to recognize human cells transduced to express P703P, demonstrating that p5 is a naturally processed epitope.

Studies identifying a further peptide epitope (referred to as peptide 4) derived from the prostate tumor-specific antigen P703P that is capable of being recognized by CD4 T cells on the surface of cells in the context of HLA class II molecules were carried out as follows. The amino acid sequence for peptide 4 is provided in SEQ ID NO: 781, with the corresponding cDNA sequence being provided in SEQ ID NO: 782.

Twenty 15-mer peptides overlapping by 10 amino acids and derived from the carboxy-terminal fragment of P703P were generated using standard procedures. Dendritic cells (DC) were derived from PBMC of a normal female donor using GM-CSF and IL-4 by standard protocols. CD4 T cells were generated from the same donor as the DC using MACS beads and negative selection. DC were pulsed overnight with pools of the 15-mer peptides, with each peptide at a final concentration of 0.25 microgram/ml. Pulsed DC were washed and plated at $1\times10^4$ cells/well of 96-well V-bottom plates and purified CD4 T cells were added at $1\times10^5$/well. Cultures were supplemented with 60 ng/ml IL-6 and 10 ng/ml IL-12 and incubated at 37° C. Cultures were restimulated as above on a weekly basis using DC generated and pulsed as above as antigen presenting cells, supplemented with 5 ng/ml IL-7 and 10 u/ml IL-2. Following 4 in vitro stimulation cycles, 96 lines (each line corresponding to one well) were tested for specific proliferation and cytokine production in response to the stimulating pools with an irrelevant pool of peptides derived from mammaglobin being used as a control.

One line (referred to as 1-F9) was identified from pool #1 that demonstrated specific proliferation (measured by 3H proliferation assays) and cytokine production (measured by interferon-gamma ELISA assays) in response to pool #1 of P703P peptides. This line was further tested for specific recognition of the peptide pool, specific recognition of individual peptides in the pool, and in HLA mismatch analyses to identify the relevant restricting allele. Line 1-F9 was found to specifically proliferate and produce interferon-gamma in response to peptide pool #1, and also to peptide 4 (SEQ ID NO: 781). Peptide 4 corresponds to amino acids 126–140 of SEQ ID NO: 327. Peptide titration experiments were conducted to assess the sensitivity of line 1-F9 for the specific peptide. The line was found to specifically respond to peptide 4 at concentrations as low as 0.25 ng/ml, indicating that the T cells are very sensitive and therefore likely to have high affinity for the epitope.

To determine the HLA restriction of the P703P response, a panel of antigen presenting cells (APC) was generated that was partially matched with the donor used to generate the T cells. The APC were pulsed with the peptide and used in proliferation and cytokine assays together with line 1-F9. APC matched with the donor at HLA-DRB0701 and HLA-DQB02 alleles were able to present the peptide to the T cells, indicating that the P703P-specific response is restricted to one of these alleles.

Antibody blocking assays were utilized to determine if the restricting allele was HLA-DR0701 or HLA-DQ02. The anti-HLA-DR blocking antibody L243 or an irrelevant isotype matched IgG2a were added to T cells and APC cultures pulsed with the peptide RMPTVLQCVNVSVVS (SEQ ID NO: 781) at 250 ng/ml. Standard interferon-gamma and proliferation assays were performed. Whereas the control antibody had no effect on the ability of the T cells to recognize peptide-pulsed APC, in both assays the anti-HLA-DR antibody completely blocked the ability of the T cells to specifically recognize peptide-pulsed APC.

To determine if the peptide epitope RMPTVLQCVNVS-VVS (SEQ ID NO: 781) was naturally processed, the ability of line 1-F9 to recognize APC pulsed with recombinant P703P protein was examined. For these experiments a number of recombinant P703P sources were utilized; *E. coli*-derived P703P, Pichia-derived P703P and baculovirus-derived P703P. Irrelevant protein controls used were *E. coli*-derived L3E a lung-specific antigen) and baculovirus-derived mammaglobin. In interferon-gamma ELISA assays, line 1-F9 was able to efficiently recognize both *E. coli* forms of P703P as well as Pichia-derived recombinant P703P, while baculovirus-derived P703P was recognized less efficiently. Subsequent Western blot analysis revealed that the *E coli* and Pichia P703P protein preparations were intact while the baculovirus P703P preparation was approximately 75% degraded. Thus, peptide RMPTVLQCVNVSVVS (SEQ ID NO: 781) from P703P is a naturally processed peptide epitope derived from P703P and presented to T cells in the context of HLA-DRB-0701

In further studies, twenty-four 15-mer peptides overlapping by 10 amino acids and derived from the N-terminal fragment of P703P (corresponding to amino acids 27–154 of SEQ ID NO: 525) were generated by standard procedures and their ability to be recognized by CD4 cells was determined essentially as described above. DC were pulsed overnight with pools of the peptides with each peptide at a final concentration of 10 microgram/ml. A large number of individual CD4 T cell lines (65/480) demonstrated significant proliferation and cytokine release (IFN-gamma) in response to the P703P peptide pools but not to a control peptide pool. The CD4 T cell lines which demonstrated specific activity were restimulated on the appropriate pool of P703P peptides and reassayed on the individual peptides of each pool as well as a peptide dose titration of the pool of peptides in a IFN-gamma release assay and in a proliferation assay.

Sixteen immunogenic peptides were recognized by the T cells from the entire set of peptide antigens tested. The amino acid sequences of these peptides are provided in SEQ ID NO: 799–814, with the corresponding cDNA sequences being provided in SEQ ID NO: 783–798, respectively. In some cases the peptide reactivity of the T cell line could be mapped to a single peptide, however some could be mapped to more than one peptide in each pool. Those CD4 T cell lines that displayed a representative pattern of recognition from each peptide pool with a reasonable affinity for peptide were chosen for further analysis (I-1A, -6A; II-4C, -5E; III-6E, IV-4B, -3F, -9B, -10F, V-5B, -4D, and -10F). These CD4 T cells lines were restimulated on the appropriate individual peptide and reassayed on autologous DC pulsed with a truncated form of recombinant P703P protein made in *E. coli* (a.a. 96–254 of SEQ ID NO: 525), full-length P703P made in the baculovirus expression system, and a fusion between influenza virus NS1 and P703P made in *E. coli*. Of the T cell lines tested, line I-1A recognized specifically the truncated form of P703P (*E. coli*) but no other recombinant form of P703P. This line also recognized the peptide used to elicit the T cells. Line 2–4C recognized the truncated form of P703P (*E. coli*) and the full length form of P703P made in baculovirus, as well as peptide. The remaining T cell lines tested were either peptide-specific only (II-5E, II-6F, IV-4B, IV-3F, IV-9B, IV-10F, V-5B and V-4D) or were non-responsive to any antigen tested (V-10F). These results demonstrate that the peptide sequence RPLLANDLM- LIKLDE (SEQ ID NO: 814; corresponding to a.a. 110–124 of SEQ ID NO: 525) recognized by the T cell line I-1A, and the peptide sequences SVSESDTIRSISIAS (SEQ ID NO: 811; corresponding to a.a. 125–139 of SEQ ID NO: 525) and ISIASQCPTAGNSCL (SEQ ID NO: 810; corresponding to a.a. 135–149 of SEQ ID NO: 525) recognized by the T cell line II-4C may be naturally processed epitopes of the P703P protein.

Example 11

Expression of a Breast Tumor-derived Antigen in Prostate

Isolation of the antigen B305D from breast tumor by differential display is described in U.S. patent application Ser. No. 08/700,014, filed Aug. 20, 1996. Several different splice forms of this antigen were isolated. The determined cDNA sequences for these splice forms are provided in SEQ ID NO: 366–375, with the predicted amino acid sequences corresponding to the sequences of SEQ ID NO: 292, 298 and 301–303 being provided in SEQ ID NO: 299–306, respectively. In further studies, a splice variant of the cDNA sequence of SEQ ID NO: 366 was isolated which was found to contain an additional guanine residue at position 884 (SEQ ID NO: 530), leading to a frameshift in the open reading frame. The determined DNA sequence of this ORF is provided in SEQ ID NO: 531. This frameshift generates a protein sequence (provided in SEQ ID NO: 532) of 293 amino acids that contains the C-terminal domain common to the other isoforms of B305D but that differs in the N-terminal region.

The expression levels of B305D in a variety of tumor and normal tissues were examined by real time PCR and by Northern analysis. The results indicated that B305D is highly expressed in breast tumor, prostate tumor, normal prostate and normal testes, with expression being low or undetectable in all other tissues examined (colon tumor, lung tumor, ovary tumor, and normal bone marrow, colon, kidney, liver, lung, ovary, skin, small intestine, stomach). Using real-time PCR on a panel of prostate tumors, expression of B305D in prostate tumors was shown to increase with increasing Gleason grade, demonstrating that expression of B305D increases as prostate cancer progresses.

Example 12

Generation of Human CTL IN VITRO Using Whole Gene Priming and Stimulation Techniques with the Prostate-specific Antigen P501S Using in vitro whole-gene priming with P501S-vaccinia infected DC (see, for example, Yee et al, *The Journal of Immunology*, 157(9):4079–86, 1996), human CTL lines were derived that specifically recognize autologous fibroblasts transduced with P501S (also known as L1-12), as determined by interferon-γ ELISPOT analysis as described above. Using a panel of HLA-mismatched B-LCL lines transduced with P501S, these CTL lines were shown to be likely restricted to HLAB class I allele. Specifically, dendritic cells (DC) were differentiated from monocyte cultures derived from PBMC of normal human donors by growing for five days in RPMI medium containing 10% human serum, 50 ng/ml human GM-CSF and 30 ng/ml human IL-4. Following culture, DC were infected overnight with recombinant P501S vaccinia virus at a multiplicity of infection (M.O.I) of five, and matured overnight by the addition of 3 μg/ml CD40 ligand. Virus was inactivated by UV irradiation. CD8+ T cells were isolated using a magnetic bead system, and priming cultures were initiated using standard culture techniques. Cultures were restimulated every 7–10 days using autologous primary fibroblasts retrovirally transduced with P501S and CD80. Following four stimulation cycles, CD8+ T cell lines were identified that specifically produced interferon-γ when stimulated with P501S and CD80-transduced autologous fibroblasts. A panel of HLA-mismatched B-LCL lines transduced with P501S were generated to define the restriction allele of the response. By measuring interferon-γ in an ELISPOT assay, the P501S specific response was shown to be likely restricted by HLA B alleles. These results demonstrate that a CD8+ CTL response to P501S can be elicited.

To identify the epitope(s) recognized, cDNA encoding P501S was fragmented by various restriction digests, and sub-cloned into the retroviral expression vector pBIB-KS. Retroviral supernatants were generated by transfection of the helper packaging line Phoenix-Ampho. Supernatants were then used to transduce Jurkat/A2Kb cells for CTL screening. CTL were screened in IFN-gamma ELISPOT assays against these A2Kb targets transduced with the "library" of P501S fragments. Initial positive fragments P501S/H3 and P501S/F2 were sequenced and found to encode amino acids 106–553 and amino acids 136–547, respectively, of SEQ ID NO: 113. A truncation of H3 was made to encode amino acid residues 106–351 of SEQ ID NO: 113, which was unable to stimulate the CTL, thus localizing the epitope to amino acid residues 351–547. Additional fragments encoding amino acids 1–472 (Fragment A) and amino acids 1–351 (Fragment B) were also constructed. Fragment A but not Fragment B stimulated the CTL thus localizing the epitope to amino acid residues 351–472. Overlapping 20-mer and 18-mer peptides representing this region were tested by pulsing Jurkat/A2Kb cells versus CTL in an IFN-gamma assay. Only peptides P501S-369(20) and P50IS-369(18) stimulated the CTL. Nine-mer and 10-mer peptides representing this region were synthesized and similarly tested. Peptide P501S-370 (SEQ ID NO: 539) was the minimal 9-mer giving a strong response. Peptide P501S-376 (SEQ ID NO: 540) also gave a weak response, suggesting that it might represent a cross-reactive epitope.

In subsequent studies, the ability of primary human B cells transduced with P501S to prime MHC class I-restricted, P501S-specific, autologous CD8 T cells was examined. Primary B cells were derived from PBMC of a homozygous HLA-A2 donor by culture in CD40 ligand and IL-4, transduced at high frequency with recombinant P501S in the vector pBIB, and selected with blastocidin-S. For in vitro priming, purified CD8+ T cells were cultured with autologous CD40 ligand+IL-4 derived, P501S-transduced B cells in a 96-well microculture format. These CTL microcultures were re-stimulated with P501S-transduced B cells and then assayed for specificity. Following this initial screen, microcultures with significant signal above background were cloned on autologous EBV-transformed B cells (BLCL), also transduced with P501S. Using IFN-gamma ELISPOT for detection, several of these CD8 T cell clones were found to be specific for P501S, as demonstrated by reactivity to BLCL/P501S but not BLCL transduced with control antigen. It was further demonstrated that the anti-P501S CD8 T cell specificity is HLA-A2-restricted. First, antibody blocking experiments with anti-HLA-A,B,C monoclonal antibody (W6.32), anti-HLA-B,C monoclonal antibody (B1.23.2) and a control monoclonal antibody showed that only the anti-HLA-A,B,C antibody blocked recognition of P501S-expressing autologous BLCL. Secondly, the anti-P501S CTL also recognized an HLA-A2 matched, heterologous BLCL transduced with P501S, but not the corresponding EGFP transduced control BLCL.

A naturally processed, CD8, class I-restricted peptide epitope of P501S was identified as follows. Dendritic Cells (DC) were isolated by Percol gradient followed by differential adherence, and cultured for 5 days in the presence of RPMI medium containing 1% human serum, 50 ng/ml GM-CSF and 30 ng/ml IL-4. Following culture, DC were infected for 24 hours with P50 S-expressing adenovirus at an MOI of 10 and matured for an additional 24 hours by the addition of 2 ug/ml CD40 ligand. CD8 cells were enriched for by the subtraction of CD4+, CD14+ and CD16+ populations from PBMC with magnetic beads. Priming cultures containing 10,000 P501S-expressing DC and 100,000 CD8+ T cells per well were set up in 96-well V-bottom plates with RPMI containing 10% human serum, 5 ng/ml IL-12 and 10 ng/ml IL-6. Cultures were stimulated every 7 days using autologous fibroblasts retrovirally transduced to express P501S and CD80, and were treated with IFN-gamma for 48–72 hours to upregulate MHC Class I expression. 10 u/ml IL-2 was added at the time of stimulation and on days 2 and 5 following stimulation. Following 4 stimulation cycles, one P501S-specific CD8+ T cell line (referred to as 2A2) was identified that produced IFN-gamma in response to IFN-gamma-treated P501S/CD80 expressing autologous fibroblasts, but not in response to IFN-gamma-treated P703P/CD80 expressing autologous fibroblasts in a γ-IFN Elispot assay. Line 2A2 was cloned in 96-well plates with 0.5 cell/well or 2 cells/well in the presence of 75,000 PBMC/well, 10,000 B-LCL/well, 30 ng/ml OKT3 and 50 u/ml IL-2. Twelve clones were isolated that showed strong P501S specificity in response to transduced fibroblasts.

Fluorescence activated cell sorting (FACS) analysis was performed on P501S-specific clones using CD3-, CD4- and CD8-specific antibodies conjugated to PercP, FITC and PE respectively. Consistent with the use of CD8 enriched T cells in the priming cultures, P5401S-specific clones were determined to be CD3+, CD8+ and CD4-.

To identify the relevant P501S epitope recognized by P501S specific CTL, pools of 18–20 mer or 30-mer peptides that spanned the majority of the amino acid sequence of P501S were loaded onto autologous B-LCL and tested in γ-IFN Elispot assays for the ability to stimulate two P501S-specific CTL clones, referred to as 4E5 and 4E7. One pool, composed of five 18–20 mer peptides that spanned amino acids 411–486 of P501S (SEQ ID NO: 113), was found to be recognized by both P501S-specific clones. To identify the specific 18–20 mer peptide recognized by the clones, each of the 18–20 mer peptides that comprised the positive pool were tested individually in γ-IFN Elispot assays for the ability to stimulate the two P501S-specific CTL clones, 4E5 and 4E7. Both 4E5 and 4E7 specifically recognized one 20-mer peptide (SEQ ID NO: 853; cDNA sequence provided in SEQ ID NO: 854) that spanned amino acids 453–472 of P501S. Since the minimal epitope recognized by CD8+ T cells is almost always either a 9 or 10-mer peptide sequence, 10-mer peptides that spanned the entire sequence of SEQ ID NO: 853 were synthesized that differed by 1 amino acid. Each of these 10-mer peptides was tested for the ability to stimulate two P501S-specific clones, (referred to as 1D5 and 1E12). One 10-mer peptide (SEQ ID NO: 855; cDNA sequence provided in SEQ ID NO: 856) was identified that specifically stimulated the P501S-specific clones. This epitope spans amino acids 463–472 of P501S. This sequence defines a minimal 10-mer epitope from P501S that can be naturally processed and to which CTL responses can be identified in normal PBMC. Thus, this epitope is a candidate for use as a vaccine moiety, and as a therapeutic and/or diagnostic reagent for prostate cancer.

To identify the class I restriction element for the P501S-derived sequence of SEQ ID NO: 855, HLA blocking and mismatch analyses were performed. In γ-IFN Elispot assays, the specific response of clones 4A7 and 4E5 to P501S-transduced autologous fibroblasts was blocked by pre-incubation with 25 ug/ml W6/32 (pan-Class I blocking antibody) and B1.23.2 (HLA-B/C blocking antibody). These results demonstrate that the SEQ ID NO: 855-specific response is restricted to an HLA-B or HLA-C allele.

For the HLA mismatch analysis, autologous B-LCL (HLA-A1,A2,B8,B51, Cw1, Cw7) and heterologous B-LCL (HLA-A2,A3,B18,B51,Cw5,Cw14) that share the HLAB51 allele were pulsed for one hour with 20 ug/ml of peptide of SEQ ID NO: 855, washed, and tested in γ-IFN Elispot assays for the ability to stimulate clones 4A7 and 4E5. Antibody blocking assays with the B1.23.2 (HLA-B/C blocking antibody) were also performed. SEQ ID NO: 855-specific response was detected using both the autologous (D326) and heterologous (D107) B-LCL, and furthermore the responses were blocked by pre-incubation with 25 ug/ml of B1.23.2 HLA-B/C blocking antibody. Together these results demonstrate that the P501S-specific response to the peptide of SEQ ID NO: 855 is restricted to the HLA-B51 class I allele. Molecular cloning and sequence analysis of the HLA-B51 allele from D3326 revealed that the HLA-B51 subtype of D326 is HLA-B51011.

Based on the 10-mer P501S-derived epitope of SEQ ID NO: 855, two 9-mers with the sequences of SEQ ID NO: 857 and 858 were synthesized and tested in Elispot assays for the ability to stimulate two P501S-specific CTL clones derived from line 2A2. The 10-mer peptide of SEQ ID NO: 855, as well as the 9-mer peptide of SEQ ID NO: 858, but not the 9-mer peptide of SEQ ID NO: 857, were capable of stimulating the P501S-specific CTL to produce IFN-gamma. These results demonstrate that the peptide of SEQ ID NO: 858 is a 9-mer P501S-derived epitope recognized by P501S-specific CTL. The DNA sequence encoding the epitope of SEQ ID NO: 858 is provided in SEQ ID NO: 859.

To identify the class I restricting allele for the P501S-derived peptide of SEQ ID NO: 855 and 858 specific response, each of the HLA B and C alleles were cloned from the donor used in the in vitro priming experiment. Sequence analysis indicated that the relevant alleles were HLA-B8, HLA-B51, HLA-Cw01 and HLA-Cw07. Each of these alleles were subcloned into an expression vector and co-transfected together with the P501S gene into VA-13 cells. Transfected VA-13 cells were then tested for the ability to specifically stimulate the P501S-specific CTL in ELISPOT assays. VA-13 cells transfected with P501S and HLA-B51 were capable of stimulating the P501S-specific CTL to secrete gamma-IFN. VA-13 cells transfected with HLA-B51 alone or P501S+the other HLA-alleles were not capable of stimulating the P501S-specific CTL. These results demonstrate that the restricting allele for the P501S-specific response is the HLAB51 allele. Sequence analysis revealed that the subtype of the relevant restricting allele is HLA-B51011.

A naturally processed CD4 epitope of P501S was identified as follows.

CD4 cells specific for P501S were prepared as described above. A series of 16 overlapping peptides were synthesized that spanned approximately 50% of the amino terminal portion of the P501S gene (amino acids 1–325 of SEQ ID NO: 113). For priming, peptides were combined into pools of 4 peptides, pulsed at 4 µg/ml onto dendritic cells (DC) for 24 hours, with TNF-alpha. DC were then washed and mixed with negatively selected CD4+ T cells in 96 well U-bottom plates. Cultures were re-stimulated weekly on fresh DC loaded with peptide pools. Following a total of 4 stimulation cycles, cells were rested for an additional week and tested for specificity to APC pulsed with peptide pools using γ-IFN ELISA and proliferation assays. For these assays, adherent monocytes loaded with either the relevant peptide pool at 4 ug/ml or an irrelevant peptide at µg/ml were used as APC. T cell lines that demonstrated either specific cytokine secretion or proliferation were then tested for recognition of individual peptides that were present in the pool. T cell lines could be identified from pools A and B that recognized individual peptides from these pools.

From pool A, lines AD9 and AE10 specifically recognized peptide 1 (SEQ ID NO: 862), and line AF5 recognized peptide 39 (SEQ ID NO: 861). From pool B, line BC6 could be identified that recognized peptide 58 (SEQ ID NO: 860). Each of these lines were stimulated on the specific peptide and tested for specific recognition of the peptide in a titration assay as well as cell lysates generated by infection of HEK 293 cells with adenovirus expressing either P501S or an irrelevant antigen. For these assays, APC-adherent monocytes were pulsed with either 10, 1, or 0.1 µg/ml individual P501S peptides, and DC were pulsed overnight with a 1:5 dilution of adenovirally infected cell lysates. Lines AD9, AE10 and AF5 retained significant recognition of the relevant P501S-derived peptides even at 0.1 mg/ml. Furthermore, line Ad9 demonstrated significant (8.1 fold stimulation index) specific activity for lysates from adenovirus-P501S infected cells. These results demonstrate that high affinity CD4 T cell lines can be generated toward P501S-derived epitopes, and that at least a subset of these T cells specific for the P501S derived sequence of SEQ ID NO: 862 are specific for an epitope that is naturally processed by human cells. The DNA sequences encoding the amino acid sequences of SEQ ID NO: 860–862 are provided in SEQ ID NO: 863–865, respectively.

Example 13

Identification of Prostate-specific Antigens by Microarray Analysis

This Example describes the isolation of certain prostate-specific polypeptides from a prostate tumor cDNA library.

A human prostate tumor cDNA expression library as described above was screened using microarray analysis to identify clones that display at least a three fold over-expression in prostate tumor and/or normal prostate tissue, as compared to non-prostate normal tissues (not including testis). 372 clones were identified, and 319 were successfully sequenced. Table I presents a summary of these clones, which are shown in SEQ ID NOs:385–400. Of these sequences SEQ ID NOs:386, 389, 390 and 392 correspond to novel genes, and SEQ ID NOs: 393 and 396 correspond to previously identified sequences. The others (SEQ ID NOs:385, 387, 388, 391, 394, 395 and 397–400) correspond to known sequences, as shown in Table I.

TABLE 1

Summary of Prostate Tumor Antigens

| Known Genes | Previously Identified Genes | Novel Genes |
|---|---|---|
| T-cell gamma chain | P504S | 23379 (SEQ ID NO: 389) |
| Kallikrein | P1000C | 23399 (SEQ ID NO: 392) |
| Vector | P501S | 23320 (SEQ ID NO: 386) |
| CGI-82 protein mRNA (23319; SEQ ID NO: 385) | P503S | 23381 (SEQ ID NO: 390) |
| PSA | P510S | |
| Ald. 6 Dehyd. | P784P | |
| L-iditol-2 dehydrogenase (23376; SEQ ID NO: 388) | P502S | |
| Ets transcription factor PDEF (22672; SEQ ID NO: 398) | P706P | |
| hTGR (22678; SEQ ID NO: 399) | 19142.2, bangur.seq (22621; SEQ ID NO: 396) | |
| KIAA0295 (22685; SEQ ID NO: 400) | 5566.1 Wang (23404; SEQ ID NO: 393) | |
| Prostatic Acid Phosphatase (22655; SEQ ID NO: 397) | P712P | |
| transglutaminase (22611; SEQ ID NO: 395) | P778P | |
| HDLBP (23508; SEQ ID NO: 394) | | |
| CGI-69 Protein (23367; SEQ ID NO: 387) | | |
| KIAA0122 (23383; SEQ ID NO: 391) | | |
| TEEG | | |

CGI-82 showed 4.06 fold over-expression in prostate tissues as compared to other normal tissues tested. It was over-expressed in 43% of prostate tumors, 25% normal prostate, not detected in other normal tissues tested. L-iditol-2 dehydrogenase showed 4.94 fold over-expression in prostate tissues as compared to other normal tissues tested. It was over-expressed in 90% of prostate tumors, 100% of normal prostate, and not detected in other normal tissues tested. Ets transcription factor PDEF showed 5.55 fold over-expression in prostate tissues as compared to other normal tissues tested. It was over-expressed in 47% prostate tumors, 25% normal prostate and not detected in other normal tissues tested. hTGR1 showed 9.11 fold over-expression in prostate tissues as compared to other normal tissues tested. It was over-expressed in 63% of prostate tumors and is not detected in normal tissues tested including normal prostate. KIAA0295 showed 5.59 fold over-expression in prostate tissues as compared to other normal tissues tested. It was over-expressed in 47% of prostate tumors, low to undetectable in normal tissues tested including normal prostate tissues. Prostatic acid phosphatase showed 9.14 fold over-expression in prostate tissues as compared to other normal tissues tested. It was over-expressed in 67% of prostate tumors, 50% of normal prostate, and not detected in other normal tissues tested. Transglutarninase showed 14.84 fold over-expression in prostate tissues as compared to other normal tissues tested. It was over-expressed in 30% of prostate tumors, 50% of normal prostate, and is not detected in other normal tissues tested. High density lipoprotein binding protein (HDLBP) showed 28.06 fold over-expression in prostate tissues as compared to other normal tissues tested. It was over-expressed in 97% of prostate tumors, 75% of normal prostate, and is undetectable in all other normal tissues tested. CGI-69 showed 3.56 fold over-expression in prostate tissues as compared to other normal tissues tested. It is a low abundant gene, detected in more than 90% of prostate tumors, and in 75% normal prostate tissues. The expression of this gene in normal tissues was very low. KIAA0122 showed 4.24 fold over-expression in prostate tissues as compared to other normal tissues tested. It was over-expressed in 57% of prostate tumors, it was undetectable in all normal tissues tested including normal prostate tissues. 19142.2 bangur showed 23.25 fold over-expression in prostate tissues as compared to other normal tissues tested. It was over-expressed in 97% of prostate tumors and 100% of normal prostate. It was undetectable in other normal tissues tested. 5566.1 Wang showed 3.31 fold over-expression in prostate tissues as compared to other normal tissues tested. It was over-expressed in 97% of prostate tumors, 75% normal prostate and was also over-expressed in normal bone marrow, pancreas, and activated PBMC. Novel clone 23379 (also referred to as P553S) showed 4.86 fold over-expression in prostate tissues as compared to other normal tissues tested. It was detectable in 97% of prostate tumors and 75% normal prostate and is undetectable in all other normal tissues tested. Novel clone 23399 showed 4.09 fold over-expression in prostate tissues as compared to other normal tissues tested. It was over-expressed in 27% of prostate tumors and was undetectable in all normal tissues tested including normal prostate tissues. Novel clone 23320 showed 3.15 fold over-expression in prostate tissues as compared to other normal tissues tested. It was detectable in all prostate tumors and 50% of normal prostate tissues. It was also expressed in normal colon and trachea. Other normal tissues do not express this gene at high level.

Subsequent full-length cloning studies on P553S, using standard techniques, revealed that this clone is an incomplete spliced form of P501S. The determined cDNA sequences for four splice variants of P553S are provided in SEQ ID NO: 702–705. An amino acid sequence encoded by SEQ ID NO: 705 is provided in SEQ ID NO: 706. The cDNA sequence of SEQ ID NO: 702 was found to contain two open reading frames (ORFs). The amino acid sequences encoded by these two ORFs are provided in SEQ ID NO: 707 and 708.

Example 14

Identification of Prostate-specific Antigens by Electronic Subtraction

This Example describes the use of an electronic subtraction technique to identify prostate-specific antigens.

Potential prostate-specific genes present in the GenBank human EST database were identified by electronic subtraction (similar to that described by Vasmatizis et al., *Proc. Natl. Acad. Sci. USA* 95:300–304, 1998). The sequences of EST clones (43,482) derived from various prostate libraries were obtained from the GenBank public human EST database. Each prostate EST sequence was used as a query sequence in a BLASTN (National Center for Biotechnology Information) search against the human EST database. All matches considered identical (length of matching sequence >100 base pairs, density of identical matches over this region >70%) were grouped (aligned) together in a cluster. Clusters containing more than 200 ESTs were discarded since they probably represented repetitive elements or highly expressed genes such as those for ribosomal proteins. If two or more clusters shared common ESTs, those clusters were grouped together into a "supercluster," resulting in 4,345 prostate superclusters.

Records for the 479 human cDNA libraries represented in the GenBank release were downloaded to create a database of these cDNA library records. These 479 cDNA libraries were grouped into three groups: Plus (normal prostate and prostate tumor libraries, and breast cell line libraries, in which expression was desired), Minus (libraries from other normal adult tissues, in which expression was not desirable), and Other (libraries from fetal tissue, infant tissue, tissues found only in women, non-prostate tumors and cell lines other than prostate cell lines, in which expression was considered to be irrelevant). A summary of these library groups is presented in Table II.

TABLE II

Prostate cDNA Libraries and ESTs

| Library | # of Libraries | # of ESTs |
|---|---|---|
| Plus | 25 | 43,482 |
| Normal | 11 | 18,875 |
| Tumor | 11 | 21,769 |
| Cell lines | 3 | 2,838 |
| Minus | 166 | |
| Other | 287 | |

Each supercluster was analyzed in terms of the ESTs within the supercluster. The tissue source of each EST clone was noted and used to classify the superclusters into four groups: Type 1-EST clones found in the Plus group libraries only; no expression detected in Minus or Other group libraries; Type 2-EST clones derived from the Plus and Other group libraries only; no expression detected in the Minus group; Type 3-EST clones derived from the Plus, Minus and Other group libraries, but the number of ESTs derived from the Plus group is higher than in either the Minus or Other groups; and Type 4-EST clones derived from Plus, Minus and Other group libraries, but the number derived from the Plus group is higher than the number derived from the Minus group. This analysis identified 4,345 breast clusters (see Table III). From these clusters, 3,172 EST clones were ordered from Research Genetics, Inc., and were received as frozen glycerol stocks in 96-well plates.

TABLE III

Prostate Cluster Summary

| Type | # of Superclusters | # of ESTs Ordered |
|---|---|---|
| 1 | 688 | 677 |
| 2 | 2899 | 2484 |
| 3 | 85 | 11 |

TABLE III-continued

Prostate Cluster Summary

| Type | # of Superclusters | # of ESTs Ordered |
|---|---|---|
| 4 | 673 | 0 |
| Total | 4345 | 3172 |

The EST clone inserts were PCR-amplified using amino-linked PCR primers for Synteni microarray analysis. When more than one PCR product was obtained for a particular clone, that PCR product was not used for expression analysis. In total, 2,528 clones from the electronic subtraction method were analyzed by microarray analysis to identify electronic subtraction breast clones that had high levels of tumor vs. normal tissue mRNA. Such screens were performed using a Synteni (Palo Alto, Calif.) microarray, according to the manufacturer's instructions (and essentially as described by Schena et al., Proc. Natl. Acad. Sci. USA 93:10614–10619, 1996 and Heller et al., Proc. Natl. Acad. Sci. USA 94:2150–2155, 1997). Within these analyses, the clones were arrayed on the chip, which was then probed with fluorescent probes generated from normal and tumor prostate cDNA, as well as various other normal tissues. The slides were scanned and the fluorescence intensity was measured.

Clones with an expression ratio greater than 3 (i.e., the level in prostate tumor and normal prostate mRNA was at least three times the level in other normal tissue mRNA) were identified as prostate tumor-specific sequences (Table IV). The sequences of these clones are provided in SEQ ID NO: 401–453, with certain novel sequences shown in SEQ ID NO: 407, 413, 416–419, 422, 426, 427 and 450.

TABLE IV

Prostate-tumor Specific Clones

| SEQ ID NO. | Sequence Designation | Comments |
|---|---|---|
| 401 | 22545 | previously identified P1000C |
| 402 | 22547 | previously identified P704P |
| 403 | 22548 | known |
| 404 | 22550 | known |
| 405 | 22551 | PSA |
| 406 | 22552 | prostate secretory protein 94 |
| 407 | 22553 | novel |
| 408 | 22558 | previously identified P509S |
| 409 | 22562 | glandular kallikrein |
| 410 | 22565 | previously identified P1000C |
| 411 | 22567 | PAP |
| 412 | 22568 | B1006C (breast tumor antigen) |
| 413 | 22570 | novel |
| 414 | 22571 | PSA |
| 415 | 22572 | previously identified P706P |
| 416 | 22573 | novel |
| 417 | 22574 | novel |
| 418 | 22575 | novel |
| 419 | 22580 | novel |
| 420 | 22581 | PAP |
| 421 | 22582 | prostatic secretory protein 94 |
| 422 | 22583 | novel |
| 423 | 22584 | prostatic secretory protein 94 |
| 424 | 22585 | prostatic secretory protein 94 |
| 425 | 22586 | known |
| 426 | 22587 | novel |
| 427 | 22588 | novel |
| 428 | 22589 | PAP |
| 429 | 22590 | known |

TABLE IV-continued

Prostate-tumor Specific Clones

| SEQ ID NO. | Sequence Designation | Comments |
|---|---|---|
| 430 | 22591 | PSA |
| 431 | 22592 | known |
| 432 | 22593 | Previously identified P777P |
| 433 | 22594 | T cell receptor gamma chain |
| 434 | 22595 | Previously identified P705P |
| 435 | 22596 | Previously identified P707P |
| 436 | 22847 | PAP |
| 437 | 22848 | known |
| 438 | 22849 | prostatic secretory protein 57 |
| 439 | 22851 | PAP |
| 440 | 22852 | PAP |
| 441 | 22853 | PAP |
| 442 | 22854 | previously identified P509S |
| 443 | 22855 | previously identified P705P |
| 444 | 22856 | previously identified P774P |
| 445 | 22857 | PSA |
| 446 | 23601 | previously identified P777P |
| 447 | 23602 | PSA |
| 448 | 23605 | PSA |
| 449 | 23606 | PSA |
| 450 | 23612 | novel |
| 451 | 23614 | PSA |
| 452 | 23618 | previously identified P1000C |
| 453 | 23622 | previously identified P705P |

Further studies on the clone of SEQ ID NO: 407 (also referred to as P1020C) led to the isolation of an extended cDNA sequence provided in SEQ ID NO: 591. This extended cDNA sequence was found to contain an open reading frame that encodes the predicted amino acid sequence of SEQ ID NO: 592. The P1020C cDNA and amino acid sequences were found to show some similarity to the human endogenous retroviral HERV-K pol gene and protein.

Example 15

Further Identification of Prostate-specific Antigens by Microarray Analysis

This Example describes the isolation of additional prostate-specific plypeptides from a prostate tumor cDNA library.

A human prostate tumor cDNA expression library as described above was screened using microarray analysis to identify clones that display at least a three fold overexpression in prostate tumor and/or normal prostate tissue, as compared to non-prostate normal tissues (not including testis). 142 clones were identified and sequenced. Certain of these clones are shown in SEQ ID NO: 454–467. Of these sequences, SEQ ID NO: 459–460 represent novel genes. The others (SEQ ID NO: 454–458 and 461–467) correspond to known sequences. Comparison of the determined cDNA sequence of SEQ ID NO: 461 with sequences in the Genbank database using the BLAST program revealed homology to the previously identified transmembrane protease serine 2 (TMPRSS2). The full-length cDNA sequence for this clone is provided in SEQ ID NO: 894, with the corresponding amino acid sequence being provided in SEQ ID NO: 895.

Example 16

Further Characterization of Prostate-specific Antigen P710P

This Example describes the full length cloning of P710P.

The prostate cDNA library described above was screened with the P710P fragment described above. One million colonies were plated on LB/Ampicillin plates. Nylon membrane filters were used to lift these colonies, and the cDNAs picked up by these filters were then denatured and cross-linked to the filters by UV light. The P710P fragment was radiolabeled and used to hybridize with the filters. Positive cDNA clones were selected and their cDNAs recovered and sequenced by an automatic Perkin Elmer/Applied Biosystems Division Sequencer. Four sequences were obtained, and are presented in SEQ ID NO: 468–471. These sequences appear to represent different splice variants of the P710P gene. Subsequent comparison of the cDNA sequences of P710P with those in Genbank releaved homology to the DD3 gene (Genbank accession numbers AF103907 & AF103908). The cDNA sequence of DD3 is provided in SEQ ID NO: 690.

Example 17

Protein Expression of Prostate-specific Antigens

This example describes the expression and purification of prostate-specific antigens in E. coli, baculovirus and mammalian cells.

a) Expression of P501S in E. coli

Expression of the full-length form of P501S was attempted by first cloning P501S without the leader sequence (amino acids 36–553 of SEQ ID NO: 113) down-stream of the first 30 amino acids of the M. tuberculosis antigen Ra12 (SEQ ID NO: 484) in pET17b. Specifically, P501S DNA was used to perform PCR using the primers AW025 (SEQ ID NO: 485) and AW003 (SEQ ID NO: 486). AW025 is a sense cloning primer that contains a HindIII site. AW003 is an antisense cloning primer that contains an EcoRI site. DNA amplification was performed using 5 µl 10×Pfu buffer, 1 µl 20 mM dNTPs, 1 µl each of the PCR primers at 10 µM concentration, 40 µl water, 1 µl Pfu DNA polymerase (Stratagene, La Jolla, Calif.) and 1 µl DNA at 100 ng/µl. Denaturation at 95° C. was performed for 30 sec, followed by 10 cycles of 95° C. for 30 sec, 60° C. for 1 min and by 72° C. for 3 min. 20 cycles of 95° C. for 30 sec, 65° C. for 1 min and by 72° C. lastly by 1 cycle of 72° C. for 10 min. The PCR product was cloned to Ra12m/pET17b using HindIII and EcoRI. The sequence of the resulting fusion construct (referred to as Ra12-P501S-F) was confirmed by DNA sequencing.

The fusion construct was transformed into BL21 (DE3) pLysE, pLysS and CodonPlus E. coli (Stratagene) and grown overnight in LB broth with kanamycin. The resulting culture was induced with IPTG. Protein was transferred to PVDF membrane and blocked with 5% non-fat milk (in PBS-Tween buffer), washed three times and incubated with mouse anti-His tag antibody (Clontech) for 1 hour. The membrane was washed 3 times and probed with HRP-Protein A (Zymed) for 30 min. Finally, the membrane was washed 3 times and developed with ECL (Amersham). No expression was detected by Western blot. Similarly, no expression was detected by Western blot when the Ra12-P501S-F fusion was used for expression in BL21CodonPlus by CE6 phage (Invitrogen).

An N-terminal fragment of P501S (amino acids 36–325 of SEQ ID NO: 113) was cloned down-stream of the first 30 amino acids of the M. tuberculosis antigen Ra12 in pET17b as follows. P501S DNA was used to perform PCR using the primers AW025 (SEQ ID NO: 485) and AW027 (SEQ ID NO: 487). AW027 is an antisense cloning primer that contains an EcoRI site and a stop codon. DNA amplification was performed essentially as described above. The resulting PCR product was cloned to Ra12 in pET17b at the HindIII and EcoRI sites. The fusion construct (referred to as Ra12-P501S-N) was confirmed by DNA sequencing.

The Ra12-P501S-N fusion construct was used for expression in BL21(DE3)pLysE, pLysS and CodonPlus, essentially as described above. Using Western blot analysis, protein bands were observed at the expected molecular weight of 36 kDa. Some high molecular weight bands were also observed, probably due to aggregation of the recombinant protein. No expression was detected by Western blot when the Ra12-P501S-F fusion was used for expression in BL21 CodonPlus by CE6 phage.

A fusion construct comprising a C-terminal portion of P501S (amino acids 257–553 of SEQ ID NO: 113) located down-stream of the first 30 amino acids of the M. tuberculosis antigen Ra12 (SEQ ID NO: 484) was prepared as follows. P501S DNA was used to perform PCR using the primers AW026 (SEQ ID NO: 488) and AW003 (SEQ ID NO: 486). AW026 is a sense cloning primer that contains a HindIII site. DNA amplification was performed essentially as described above. The resulting PCR product was cloned to Ra12 in pET17b at the HindIII and EcoRI sites. The sequence for the fusion construct (referred to as Ra12-P501S-C) was confirmed.

The Ra12-P501S-C fusion construct was used for expression in BL21(DE3)pLysE, pLysS and CodonPlus, as described above. A small amount of protein was detected by Western blot, with some molecular weight aggregates also being observed. Expression was also detected by Western blot when the Ra12-P501S-C fusion was used for expression in BL2lCodonPlus induced by CE6 phage.

A fusion construct comprising a fragment of P501S (amino acids 36–298 of SEQ ID NO: 113) located down-stream of the M. tuberculosis antigen Ra12 (SEQ ID NO: 848) was prepared as follows. P501S DNA was used to perform PCR using the primers AW042 (SEQ ID NO: 849) and AW053 (SEQ ID NO: 850). AW042 is a sense cloning primer that contains a EcoRI site. AW053 is an antisense primer with stop and Xho I sites. DNA amplification was performed essentially as described above. The resulting PCR product was cloned to Ra12 in pET17b at the EcoRI and Xho I sites. The resulting fusion construct (referred to as Ra12-P501S-E2) was expressed in B834 (DE3) pLys S E. coli host cells in TB media for 2 h at room temperature. Expressed protein was purified by washing the inclusion bodies and running on a Ni-NTA column. The purified protein stayed soluble in buffer containing 20 mM Tris-HCl (pH 8), 100 mM NaCl, 10 mM β-Me and 5% glycerol. The determined cDNA and amino acid sequences for the expressed fusion protein are provided in SEQ ID NO: 851 and 852, respectfully.

b) Expression of P501S in Baculovirus

The Bac-to-Bac baculovirus expression system (BRL Life Technologies, Inc.) was used to express P501S protein in insect cells. Full-length P501S (SEQ ID NO: 113) was amplified by PCR and cloned into the XbaI site of the donor plasmid pFastBacI. The recombinant bacmid and baculovirus were prepared according to the manufacturer's instructions. The recombinant baculovirus was amplified in Sf9 cells and the high titer viral stocks were utilized to infect High Five cells (Invitrogen) to make the recombinant protein. The identity of the full-length protein was confirmed by N-terminal sequencing of the recombinant protein and by Western blot analysis (FIG. 7). Specifically, 0.6 million High Five cells in 6-well plates were infected with either the unrelated control virus BV/ECD_PD (lane 2), with recombinant baculovirus for P501S at different amounts or MOIs (lanes 4–8), or were uninfected (lane 3). Cell lysates were run on SDS-PAGE under reducing conditions and analyzed by Western blot with the anti-P501S monoclonal antibody P501S-10E3-G4D3 (prepared as described below). Lane 1 is the biotinylated protein molecular weight marker (BioLabs).

The localization of recombinant P501S in the insect cells was investigated as follows. The insect cells overexpressing P501S were fractionated into fractions of nucleus, mitochondria, membrane and cytosol. Equal amounts of protein from each fraction were analyzed by Western blot with a monoclonal antibody against P501S. Due to the scheme of fractionation, both nucleus and mitochondria fractions contain some plasma membrane components. However, the membrane fraction is basically free from mitochondria and nucleus. P501S was found to be present in all fractions that contain the membrane component, suggesting that P501S may be associated with plasma membrane of the insect cells expressing the recombinant protein.

c) Expression of P501S in Mammalian Cells

Full-length P501S (553AA) was cloned into various mammalian expression vectors, including pCEP4 (Invitrogen), pVR1012 (Vical, San Diego, Calif.) and a modified form of the retroviral vector pBMN, referred to as pBIB. Transfection of P501S/pCEP4 and P501S/pVR1012 into HEK293 fibroblasts was carried out using the Fugene transfection reagent (Boehringer Mannheim). Briefly, 2 ul of Fugene reagent was diluted into 100 ul of serum-free media and incubated at room temperature for 5–10 min. This mixture was added to 1 ug of P501S plasmid DNA, mixed briefly and incubated for 30 minutes at room temperature. The Fugene/DNA mixture was added to cells and incubated for 24–48 hours. Expression of recombinant P501S in transfected HEK293 fibroblasts was detected by means of Western blot employing a monoclonal antibody to P501S.

Transfection of p501S/pCEP4 into CHO-K cells (American Type Culture Collection, Rockville, Md.) was carried out using GenePorter transfection reagent (Gene Therapy Systems, San Diego, Calif.). Briefly, 15 µl of GenePorter was diluted in 500 µl of serum-free media and incubated at room temperature for 10 min. The GenePorter/media mixture was added to 2 µg of plasmid DNA that was diluted in 500 µl of serum-free media, mixed briefly and incubated for 30 min at room temperature. CHO-K cells were rinsed in PBS to remove serum proteins, and the GenePorter/DNA mix was added and incubated for 5 hours. The transfected cells were then fed an equal volume of 2×media and incubated for 24–48 hours.

FACS analysis of P501S transiently infected CHO-K cells, demonstrated surface expression of P501S. Expression was detected using rabbit polyclonal antisera raised against a P501S peptide, as described below. Flow cytometric analysis was performed using a FaCScan (Becton Dickinson), and the data were analyzed using the Cell Quest program.

d) Expression of P703P in Baculovirus

The cDNA for full-length P703P-DE5 (SEQ ID NO: 326), together with several flanking restriction sites, was obtained by digesting the plasmid pcDNA703 with restriction endonucleases Xba I and Hind III. The resulting restriction fragment (approx. 800 base pairs) was ligated into the transfer plasmid pFastBacI which was digested with the same restriction enzymes. The sequence of the insert was confirmed by DNA sequencing. The recombinant transfer plasmid pFBP703 was used to make recombinant bacmid DNA and baculovirus using the Bac-To-Bac Baculovirus expression system (BRL Life Technologies). High Five cells were infected with the recombinant virus BVP703, as described above, to obtain recombinant P703P protein.

e) Expression of P788P in E. Coli A truncated, N-terminal portion, of P788P (residues 1–644 of SEQ ID NO: 777; referred to as P788P-N) fused with a C-terminal 6×His Tag was expressed in E. coli as follows. P788P cDNA was amplified using the primers AW080 and AW081 (SEQ ID NO: 815 and 816). AW080 is a sense cloning primer with an NdeI site. AW081 is an antisense cloning primer with a XhoI site. The PCR-amplified P788P, as well as the vector pCRX1, were digested with NdeI and XhoI. Vector and insert were ligated and transformed into NovaBlue cells. Colonies were randomly screened for insert and then sequenced. P788P-N clone #6 was confirmed to be identical to the designed construct. The expression construct P788P-N #6/pCRX1 was transformed into E. coli BL21 CodonPlus-RIL competent cells. After induction, most of the cells grew well, achieving OD600 of greater than 2.0 after 3 hr. Coomassie stained SDS-PAGE showed an over-expressed band at about 75 kD. Western blot analysis using a 6×HisTag antibody confirmed the band was P788P-N. The determined cDNA sequence for P788P-N is provided in SEQ ID NO: 817, with the corresponding amino acid sequence being provided in SEQ ID NO: 818.

f) Expression of P510S in E. Coli

The P510S protein has 9 potential transmembrane domains and is predicted to be located at the plasma membrane. The C-terminal protein of this protein, as well as the predicted third extracellular domain of P510S were expressed in E. coli as follows.

The expression construct referred to as Ra12-P501S-C was designed to have a 6 HisTag at the N-terminal enc, followed by the M. tuberculosis antigen Ra12 (SEQ ID NO: 819) and then the C-terminal portion of P510S (amino residues 1176–1261 of SEQ ID NO: 538). Full-length P510S was used to amplify the P510S-C fragment by PCR using the primers AW056 and AW057 (SEQ ID NO: 820 and 821, respectively). AW056 is a sense cloning primer with an EcoRI site. AW057 is an antisense primer with stop and XhoI sites. The amplified P501S fragment and Ra12/pCRX1 were digested with EcoRI and XhoI and then purified. The insert and vector were ligated together and transformed into NovaBlue. Colonies were randomly screened for insert and sequences. For protein expression, the expression construct was transformed into E. coli BL21 (DE3) CodonPlus-RIL competent cells. A mini-induction screen was performed to optimize the expression conditions. After induction the cells grew well, achieving OD 600 nm greater than 2.0 after 3 hours. Coomassie stain SDS-PAGE showed a highly over-expressed band at approx. 30 kD. Though this is higher than the expected molecular weight, western blot analysis was positive, showing this band to be the His tag-containing protein. The optimized culture conditions are as follows. Dilute overnight culture/daytime culture (LB+kanamycin+chloramphenicol) into 2×YT (with kanamycin and chloramphenicol) at a ratio of 25 ml culture to 1 liter 2×YT. Allow to grow at 37° C. until OD600=0.6. Take an aliquot out as T0 sample. Add 1 mM IPTG and allow to grow at 30° C. for 3 hours. Take out a T3 sample, spin down cells and store at −80° C. The determined cDNA and amino acid sequences for the Ra12-P510S-C construct are provided in SEQ ID NO: 822 and 825, respectively.

The expression construct P510S-C was designed to have a 5' added start codon and a glycine (GGA) codon and then the P510S-C terminal fragment followed by the in frame 6xhistidine tag and stop codon from the pET28b vector. The cloning strategy is similar to that used for Ra12-P510S-C, except that the PCR primers employed were those shown in SEQ ID NO: 828 and 829, respectively and the NcoI/XhoI cut in pET28b was used. The primer of SEQ ID NO: 828 created a 5' NcoI site and added a start codon. The antisense primer of SEQ ID NO: 829 creates a XhoI site on P510S C terminal fragment. Clones were confirmed by sequencing. For protein expression, the expression construct was transformed into E. coli BL21 (DE3) CodonPlus-RIL competent cells. An OD600 of greater than 2.0 was obtained 30 hours after induction. Coomassie stained SDS-PAGE showed an over-expressed band at about 11 kD. Western blot analysis confirmed that the band was P510S-C, as did N-terminal protein sequencing. The optimized culture conditions are as follows: dilute overnight culture/daytime culture (LB+kanamycin+chloramphenicol) into 2×YT (+kanamycin and chloramphenicol) at a ratio of 25 mL culture to 1 liter 2×YT, and allow to grow at 37° C. until an OD 600 of about 0.5 is reached. Take out an aliquot as T0 sample. Add 1 mM IPTG and allow to grow at 30° C. for 3 hours. Spin down the cells and store at −80° C. until purification. The determined cDNA and amino acid sequences for the P510S-C construct are shown in SEQ ID NO: 823 and 826, respectively.

The predicted third extracellular domain of P510S (P510S-E3; residues 328–676 of SEQ ID NO: 538) was expressed in E. coli as follows. The P510S fragment was amplified by PCR using the primers shown in SEQ ID NO: 830 and 831. The primer of SEQ ID NO: 830 is a sense primer with an NdeI site for use in ligating into pPDM. The primer of SEQ ID NO: 831 is an antisense primer with an added XhoI site for use in ligating into pPDM. The resulting fragment was cloned to pPDM at the NdeI and XhoI sites. Clones were confirmed by sequencing. For protein expression, the clone ws transformed into E. coli BL21 (DE3) CodonPlus-RIL competent cells. After induction, an OD600 of greater than 2.0 was achieved after 3 hours. Coomassie stained SDS-PAGE showed an over-expressed band at about 39 kD, and N-terminal sequencing confirmed the N-terminal to be that of P510S-E3. Optimized culture conditions are as follows: dilute overnight culture/daytime culture (LB+kanamycin+chloramphenicol) into 2×YT (kanamycin and chlorampbenicol) at a ratio of 25 ml culture to 1 liter 2×YT. Allow to grow at 37° C. until OD 600 equals 0.6. Take out an aliquot as T0 sample. Add 1 mM IPTG and allow to grow at 30° C. for 3 hours. Take out a T3 sample, spin down the cells and store at −80° C. until purification. The determined cDNA and amino acid sequences for the P501S-E3 construct are provided in SEQ ID NO: 824 and 827, respectively.

g) Expression of P775S in E. Coli

The antigen P775P contains multiple open reading frames (ORF). The third ORF, encoding the protein of SEQ ID NO: 483, has the best emotif score. An expression fusion construct containing the M. tuberculosis antigen Ra12 (SEQ ID NO: 819) and P775P-ORF3 with an N-terminal 6xHisTag was prepared as follows. P775P-ORF3 was amplified using the sense PCR primers of SEQ ID NO: 832 and the antisense PCR primer of SEQ ID NO: 833. The PCR amplified fragment of P775P and Ra12/pCRX1 were digested with the restriction enzymes EcoRI and XhoI. Vector and insert were ligated and then transformed into NovaBlue cells. Colonies were randomly screened for insert and then sequenced. A clone having the desired sequence was transformed into E. coli BL21 (DE3) CodonPlus-RIL competent cells. Two hours after induction, the cell density peaked at OD600 of approximately 1.8. Coomassie stained SDS-PAGE showed an over-expressed band at about 31 kD. Western blot using 6xHisTag antibody confirmed that the band was Ra12-P775P-ORF3. The determined cDNA and amino acid sequences for the fusion construct are provided in SEQ ID NO: 834 and 835, respectively.

H) Expression of a P703P His Tag Fusion Protein in E. coli

The cDNA for the coding region of P703P was prepared by PCR using the primers of SEQ ID NO: 836 and 837. The PCR product was digested with EcoRI restriction enzyme, gel purified and cloned into a modified pET28 vector with a His tag in frame, which had been digested with Eco72I and EcoRI restriction enzymes. The correct construct was confirmed by DNA sequence analysis and then transformed into E. coli BL21 (DE3) pLys S expression host cells. The determined amino acid and cDNA sequences for the expressed recombinant P703P are provided in SEQ ID NO: 838 and 839, respectively.

I) Expression of a P705P His Tag Fusion Protein in E. coli

The cDNA for the coding region of P705P was prepared by PCR using the primers of SEQ ID NO: 840 and 841. The PCR product was digested with EcoRI restriction enzyme, gel purified and cloned into a modified pET28 vector with a His tag in frame, which had been digested with Eco72I and EcoRI restriction enzymes. The correct construct was confirmed by DNA sequence analysis and then transformed into E. coli BL21 (DE3) pLys S and BL21 (DE3) CodonPlus expression host cells. The determined amino acid and cDNA sequences for the expressed recombinant P705P are provided in SEQ ID NO: 842 and 843, respectively.

J) Expression of a P711P His Tag Fusion Protein in E. coli

The cDNA for the coding region of P711 P was prepared by PCR using the primers of SEQ ID NO: 844 and 845. The PCR product was digested with EcoRI restriction enzyme, gel purified and cloned into a modified pET28 vector with a His tag in frame, which had been digested with Eco72I and EcoRI restriction enzymes. The correct construct was confirmed by DNA sequence analysis and then transformed into E. coli BL21 (DE3) pLys S and BL21 (DE3) CodonPlus expression host cells. The determined amino acid and cDNA sequences for the expressed recombinant P711 P are provided in SEQ ID NO: 846 and 847, respectively.

Example 18

Preparation and Characterization of Antibodies Against Prostate-specific Polypeptides a) Preparation and Characterization of Polyclonal Antibodies against P703P, P504S and P509S Polyclonal antibodies against P703P, P504S and P509S were prepared as follows.

Each prostate tumor antigen expressed in an E. coli recombinant expression system was grown overnight in LB broth with the appropriate antibiotics at 37° C. in a shaking incubator. The next morning, 10 ml of the overnight culture was added to 500 ml to 2×YT plus appropriate antibiotics in a 2L-baffled Erlenmeyer flask. When the Optical Density (at 560 nm) of the culture reached 0.4–0.6, the cells were induced with IPTG (1 mM). Four hours after induction with IPTG, the cells were harvested by centrifugation. The cells were then washed with phosphate buffered saline and centrifuged again. The supernatant was discarded and the cells were either frozen for future use or immediately processed. Twenty ml of lysis buffer was added to the cell pellets and vortexed. To break open the E. coli cells, this mixture was then run through the French Press at a pressure of 16,000 psi.

The cells were then centrifuged again and the supernatant and pellet were checked by SDS-PAGE for the partitioning of the recombinant protein. For proteins that localized to the cell pellet, the pellet was resuspended in 10 mM Tris pH 8.0, 1% CHAPS and the inclusion body pellet was washed and centrifuged again. This procedure was repeated twice more. The washed inclusion body pellet was solubilized with either 8 M urea or 6 M guanidine HCl containing 10 mM Tris pH 8.0 plus 10 mM imidazole. The solubilized protein was added to 5 ml of nickel-chelate resin (Qiagen) and incubated for 45 min to 1 hour at room temperature with continuous agitation. After incubation, the resin and protein mixture were poured through a disposable column and the flow through was collected. The column was then washed with 10–20 column volumes of the solubilization buffer. The antigen was then eluted from the column using 8M urea, 10 mM Tris pH 8.0 and 300 mM imidazole and collected in 3 ml fractions. A SDS-PAGE gel was run to determine which fractions to pool for further purification.

As a final purification step, a strong anion exchange resin such as HiPrepQ (Biorad) was equilibrated with the appropriate buffer and the pooled fractions from above were loaded onto the column. Each antigen was eluted off the column with a increasing salt gradient. Fractions were collected as the column was run and another SDS-PAGE gel was run to determine which fractions from the column to pool. The pooled fractions were dialyzed against 10 mM Tris pH 8.0. The proteins were then vialed after filtration through a 0.22 micron filter and the antigens were frozen until needed for immunization.

Four hundred micrograms of each prostate antigen was combined with 100 micrograms of muramyldipeptide (MDP). Every four weeks rabbits were boosted with 100 micrograms mixed with an equal volume of Incomplete Freund's Adjuvant (IFA). Seven days following each boost, the animal was bled. Sera was generated by incubating the blood at 4° C. for 12–4 hours followed by centrifugation.

Ninety-six well plates were coated with antigen by incubating with 50 microliters (typically 1 microgram) of recombinant protein at 4° C. for 20 hours. 250 microliters of BSA blocking buffer was added to the wells and incubated at room temperature for 2 hours. Plates were washed 6 times with PBS/0.01% Tween. Rabbit sera was diluted in PBS. Fifty microliters of diluted sera was added to each well and incubated at room temperature for 30 min. Plates were washed as described above before 50 microliters of goat anti-rabbit horse radish peroxidase (HRP) at a 1:10000 dilution was added and incubated at room temperature for 30 min. Plates were again washed as described above and 100 microliters of TMB microwell peroxidase substrate was added to each well. Following a 15 min incubation in the dark at room temperature, the calorimetric reaction was stopped with 100 microliters of 1N $H_2SO_4$ and read immediately at 450 nm. All polyclonal antibodies showed immunoreactivity to the appropriate antigen.

b) Preparation and Characterization of Antibodies against P501S

A murine monoclonal antibody directed against the carboxy-terminus of the prostate-specific antigen P501S was prepared as follows.

A truncated fragment of P501S (amino acids 355–526 of SEQ ID NO: 113) was generated and cloned into the pET28b vector (Novagen) and expressed in *E. coli* as a thioredoxin fusion protein with a histidine tag. The trx-P501S fusion protein was purified by nickel chromatography, digested with thrombin to remove the trx fragment and further purified by an acid precipitation procedure followed by reverse phase HPLC.

Mice were immunized with truncated P501S protein. Serum bleeds from mice that potentially contained anti-P501S polyclonal sera were tested for P501S-specific reactivity using ELISA assays with purified P501S and trx-P501S proteins. Serum bleeds that appeared to react specifically with P501S were then screened for P501S reactivity by Western analysis. Mice that contained a P501S-specific antibody component were sacrificed and spleen cells were used to generate anti-P501S antibody producing hybridomas using standard techniques. Hybridoma supernatants were tested for P501S-specific reactivity initially by ELISA, and subsequently by FACS analysis of reactivity with P501S transduced cells. Based on these results, a monoclonal hybridoma referred to as 10E3 was chosen for further subcloning. A number of subclones were generated, tested for specific reactivity to P501S using ELISA and typed for IgG isotype. The results of this analysis are shown below in Table V. Of the 16 subclones tested, the monoclonal antibody 10E3-G4-D3 was selected for further study.

TABLE V

Isotype analysis of murine anti-P501S monoclonal antibodies

| Hybridoma clone | Isotype | Estimated [Ig] in supernatant (µg/ml) |
|---|---|---|
| 4D11 | IgG1 | 14.6 |
| 1G1 | IgG1 | 0.6 |
| 4F6 | IgG1 | 72 |
| 4H5 | IgG1 | 13.8 |
| 4H5-E12 | IgG1 | 10.7 |
| 4H5-EH2 | IgG1 | 9.2 |
| 4H5-H2-A10 | IgG1 | 10 |
| 4H5-H2-A3 | IgG1 | 12.8 |
| 4H5-H2-A10-G6 | IgG1 | 13.6 |
| 4H5-H2-B11 | IgG1 | 12.3 |
| 10E3 | IgG2a | 3.4 |
| 10E3-D4 | IgG2a | 3.8 |
| 10E3-D4-G3 | IgG2a | 9.5 |
| 10E3-D4-G6 | IgG2a | 10.4 |
| 10E3-E7 | IgG2a | 6.5 |
| 8H12 | IgG2a | 0.6 |

The specificity of 10E3-G4-D3 for P501S was examined by FACS analysis. Specifically, cells were fixed (2% formaldehyde, 10 minutes), permeabilized (0.1% saponin, 10 minutes) and stained with 10E3-G4-D3 at 0.5–1 µg/ml, followed by incubation with a secondary, FITC-conjugated goat anti-mouse Ig antibody (Pharmingen, San Diego, Calif.). Cells were then analyzed for FITC fluorescence using an Excalibur fluorescence activated cell sorter. For FACS analysis of transduced cells, B-LCL were retrovirally transduced with P501S. For analysis of infected cells, B-LCL were infected with a vaccinia vector that expresses P501S. To demonstrate specificity in these assays, B-LCL transduced with a different antigen (P703P) and uninfected B-LCL vectors were utilized. 10E3-G4-D3 was shown to bind with P5OIS-transduced B-LCL and also with P501S-infected B-LCL, but not with either uninfected cells or P703P-transduced cells.

To determine whether the epitope recognized by 10E3-G4-D3 was found on the surface or in an intracellular compartment of cells, B-LCL were transduced with P501S or HLA-B8 as a control antigen and either fixed and permeabilized as described above or directly stained with 10E3-G4-D3 and analyzed as above. Specific recognition of P501S by 10E3-G4-D3 was found to require permeabilization, suggesting that the epitope recognized by this antibody is intracellular.

The reactivity of 10E3-G4-D3 with the three prostate tumor cell lines Lncap, PC-3 and DU-145, which are known to express high, medium and very low levels of P501S, respectively, was examined by permeabilizing the cells and treating them as described above. Higher reactivity of 10E3-G4-D3 was seen with Lncap than with PC-3, which in turn showed higher reactivity that DU-145. These results are in agreement with the real time PCR and demonstrate that the antibody specifically recognizes P501S in these tumor cell lines and that the epitope recognized in prostate tumor cell lines is also intracellular.

Specificity of 10E3-G4-D3 for P501S was also demonstrated by Western blot analysis. Lysates from the prostate tumor cell lines Lncap, DU-145 and PC-3, from P501S-transiently transfected HEK293 cells, and from non-transfected HEK293 cells were generated. Western blot analysis of these lysates with 10E3-G4-D3 revealed a 46 kDa immunoreactive band in Lncap, PC-3 and P501S-transfected HEK cells, but not in DU-145 cells or non-transfected HEK293 cells. P501S mRNA expression is consistent with these results since semi-quantitative PCR analysis revealed that P501S mRNA is expressed in Lncap, to a lesser but detectable level in PC-3 and not at all in DU-145 cells. Bacterially expressed and purified recombinant P501S (referred to as P501SStr2) was recognized by 10E3-G4-D3 (24 kDa), as was full-length P501S that was transiently expressed in HEK293 cells using either the expression vector VR1012 or pCEP4. Although the predicted molecular weight of P501S is 60.5 kDa, both transfected and "native" P501S run at a slightly lower mobility due to its hydrophobic nature.

Immunohistochemical analysis was performed on prostate tumor and a panel of normal tissue sections (prostate, adrenal, breast, cervix, colon, duodenum, gall bladder, ileum, kidney, ovary, pancreas, parotid gland, skeletal muscle, spleen and testis). Tissue samples were fixed in formalin solution for 24 hours and embedded in paraffin before being sliced into 10 micron sections. Tissue sections were permeabilized and incubated with 10E3-G4-D3 antibody for 1 hr. HRP-labeled anti-mouse followed by incubation with DAB chromogen was used to visualize P501S immunoreactivity. P501S was found to be highly expressed in both normal prostate and prostate tumor tissue but was not detected in any of the other tissues tested.

To identify the epitope recognized by 10E3-G4-D3, an epitope mapping approach was pursued. A series of 13 overlapping 20–21 mers (5 amino acid overlap; SEQ ID NO: 489–501) was synthesized that spanned the fragment of P501S used to generate 10E3-G4-D3. Flat bottom 96 well microtiter plates were coated with either the peptides or the P501S fragment used to immunize mice, at 1 microgram/ml for 2 hours at 37° C. Wells were then aspirated and blocked with phosphate buffered saline containing 1% (w/v) BSA for 2 hours at room temperature, and subsequently washed in PBS containing 0.1% Tween 20 (PBST). Purified antibody 10E3-G4-D3 was added at 2 fold dilutions (1000 ng–16 ng) in PBST and incubated for 30 minutes at room temperature. This was followed by washing 6 times with PBST and subsequently incubating with HRP-conjugated donkey anti-mouse IgG (H+L)Affinipure F(ab') fragment (Jackson Immunoresearch, West Grove, Pa.) at 1:20000 for 30 minutes. Plates were then washed and incubated for 15 minutes in tetramethyl benzidine. Reactions were stopped by the addition of 1N sulfuric acid and plates were read at 450 nm using an ELISA plate reader. As shown in FIG. 8, reactivity was seen with the peptide of SEQ ID NO: 496 (corresponding to amino acids 439–459 of P501S) and with the P501S fragment but not with the remaining peptides, demonstrating that the epitope recognized by 10E3-G4-D3 is localized to amino acids 439–459 of SEQ ID NO: 113.

In order to further evaluate the tissue specificity of P501S, multi-array immunohistochemical analysis was performed on approximately 4700 different human tissues encompassing all the major normal organs as well as neoplasias derived from these tissues. Sixty-five of these human tissue samples were of prostate origin. Tissue sections 0.6 mm in diameter were formalin-fixed and paraffin embedded. Samples were pretreated with HIER using 10 mM citrate buffer pH 6.0 and boiling for 10 min. Sections were stained with 10E3-G4-D3 and P501S immunoreactivity was visualized with HRP. All the 65 prostate tissues samples (5 normal, 55 untreated prostate tumors, 5 hormone refractory prostate tumors) were positive, showing distinct perinuclear staining. All other tissues examined were negative for P501S expression.

c) Preparation and Characterization of Antibodies against P503S

A fragment of P503S (amino acids 113–241 of SEQ ID NO: 114) was expressed and purified from bacteria essentially as described above for P501S and used to immunize both rabbits and mice. Mouse monoclonal antibodies were isolated using standard hybridoma technology as described above. Rabbit monoclonal antibodies were isolated using Selected Lymphocyte Antibody Method (SLAM) technology at Immgenics Pharmaceuticals (Vancouver, BC, Canada). Table VI, below, lists the monoclonal antibodies that were developed against P503S.

TABLE VI

| Antibody | Species |
|---|---|
| 20D4 | Rabbit |
| JA1 | Rabbit |
| 1A4 | Mouse |
| 1C3 | Mouse |
| 1C9 | Mouse |
| 1D12 | Mouse |
| 2A11 | Mouse |
| 2H9 | Mouse |
| 4H7 | Mouse |
| 8A8 | Mouse |
| 8D10 | Mouse |
| 9C12 | Mouse |
| 6D12 | Mouse |

The DNA sequences encoding the complementarity determining regions (CDRs) for the rabbit monoclonal antibodies 20D4 and JA1 were determined and are provided in SEQ ID NO: 502 and 503, respectively.

In order to better define the epitope binding region of each of the antibodies, a series of overlapping peptides were generated that span amino acids 109–213 of SEQ ID NO: 114. These peptides were used to epitope map the anti-P503S monoclonal antibodies by ELISA as follows. The recombinant fragment of P503S that was employed as the immunogen was used as a positive control. Ninety-six well microtiter plates were coated with either peptide or recombinant antigen at 20 ng/well overnight at 4° C. Plates were aspirated and blocked with phosphate buffered saline containing 1% (w/v) BSA for 2 hours at room temperature then washed in PBS containing 0.1% Tween 20 (PBST). Purified rabbit monoclonal antibodies diluted in PBST were added to the wells and incubated for 30 min at room temperature. This was followed by washing 6 times with PBST and incubation with Protein-A HRP conjugate at a 1:2000 dilution for a further 30 min. Plates were washed six times in PBST and incubated with tetramethylbenzidine (TMB) substrate for a further 15 min. The reaction was stopped by the addition of 1N sulfuric acid and plates were read at 450 nm using at ELISA plate reader. ELISA with the mouse monoclonal antibodies was performed with supernatants from tissue culture run neat in the assay.

All of the antibodies bound to the recombinant P503S fragment, with the exception of the negative control SP2 supernatant. 20D4, JA1 and 1D12 bound strictly to peptide #2101 (SEQ ID NO: 504), which corresponds to amino acids 151–169 of SEQ ID NO: 114. 1C3 bound to peptide #2102 (SEQ ID NO: 505), which corresponds to amino acids 165–184 of SEQ ID NO: 114. 9C12 bound to peptide #2099 (SEQ ID NO: 522), which corresponds to amino acids 120–139 of SEQ ID NO: 114. The other antibodies bind to regions that were not examined in these studies.

Subsequent to epitope mapping, the antibodies were tested by FACS analysis on a cell line that stably expressed P503S to confirm that the antibodies bind to cell surface epitopes. Cells stably transfected with a control plasmid were employed as a negative control. Cells were stained live with no fixative. 0.5 ug of anti-P503S monoclonal antibody was added and cells were incubated on ice for 30 min before being washed twice and incubated with a FITC-labelled goat anti-rabbit or mouse secondary antibody for 20 min. After being washed twice, cells were analyzed with an Excalibur fluorescent activated cell sorter. The monoclonal antibodies 1C3, 1D12, 9C12, 20D4 and JA1, but not 8D3, were found to bind to a cell surface epitope of P503S.

In order to determine which tissues express P503S, immunohistochemical analysis was performed, essentially as described above, on a panel of normal tissues (prostate, adrenal, breast, cervix, colon, duodenum, gall bladder, ileum, kidney, ovary, pancreas, parotid gland, skeletal muscle, spleen and testis). HRP-labeled anti-mouse or anti-rabbit antibody followed by incubation with TMB was used to visualize P503S immunoreactivity. P503S was found to be highly expressed in prostate tissue, with lower levels of expression being observed in cervix, colon, ileum and kidney, and no expression being observed in adrenal, breast, duodenum, gall bladder, ovary, pancreas, parotid gland, skeletal muscle, spleen and testis.

Western blot analysis was used to characterize anti-P503S monoclonal antibody specificity. SDS-PAGE was performed on recombinant (rec) P503S expressed in and purified from bacteria and on lysates from HEK293 cells transfected with full length P503S. Protein was transferred to nitrocellulose and then Western blotted with each of the anti-P503S monoclonal antibodies (20D4, JA1, 1D12, 6D12 and 9C12) at an antibody concentration of 1 ug/ml. Protein was detected using horse radish peroxidase (HRP) conjugated to either a goat anti-mouse monoclonal antibody or to protein A-sepharose. The monoclonal antibody 20D4 detected the appropriate molecular weight 14 kDa recombinant P503S (amino acids 113–241) and the 23.5 kDa species in the HEK293 cell lysates transfected with full length P503S. Other anti-P503S monoclonal antibodies displayed similar specificity by Western blot.

d) Preparation and Characterization of Antibodies against P703P

Rabbits were immunized with either a truncated (P703Ptr1; SEQ ID NO: 172) or full-length mature form (P703Pf1; SEQ ID NO: 523) of recombinant P703P protein was expressed in and purified from bacteria as described above. Affinity purified polyclonal antibody was generated using immunogen P703Pf1 or P703Ptr1 attached to a solid support. Rabbit monoclonal antibodies were isolated using SLAM technology at Immgenics Pharmaceuticals. Table VII below lists both the polyclonal and monoclonal antibodies that were generated against P703P.

TABLE VII

| Antibody | Immunogen | Species/type |
| --- | --- | --- |
| Aff. Purif. P703P (truncated); #2594 | P703Ptrl | Rabbit polyclonal |
| Aff. Purif. P703P (full length); #9245 | P703Pfl | Rabbit polyclonal |
| 2D4 | P703Ptrl | Rabbit monoclonal |
| 8H2 | P703Ptrl | Rabbit monoclonal |
| 7H8 | P703Ptrl | Rabbit monoclonal |

The DNA sequences encoding the complementarity determining regions (CDRs) for the rabbit monoclonal antibodies 8H2, 7H8 and 2D4 were determined and are provided in SEQ ID NO: 506–508, respectively.

Epitope mapping studies were performed as described above. Monoclonal antibodies 2D4 and 7H8 were found to specifically bind to the peptides of SEQ ID NO: 509 (corresponding to amino acids 145–159 of SEQ ID NO: 172) and SEQ ID NO: 510 (corresponding to amino acids 11–25 of SEQ ID NO: 172), respectively. The polyclonal antibody 2594 was found to bind to the peptides of SEQ ID NO: 511–514, with the polyclonal antibody 9427 binding to the peptides of SEQ ID NO: 515–517.

The specificity of the anti-P703P antibodies was determined by Western blot analysis as follows. SDS-PAGE was performed on (1) bacterially expressed recombinant antigen; (2) lysates of HEK293 cells and Ltk-/-cells either untransfected or transfected with a plasmid expressing full length P703P; and (3) supernatant isolated from these cell cultures. Protein was transferred to nitrocellulose and then Western blotted using the anti-P703P polyclonal antibody #2594 at an antibody concentration of 1 ug/ml. Protein was detected using horse radish peroxidase (HRP) conjugated to an anti-rabbit antibody. A 35 kDa immunoreactive band could be observed with recombinant P703P. Recombinant P703P runs at a slightly higher molecular weight since it is epitope tagged. In lysates and supernatants from cells transfected with full length P703P, a 30 kDa band corresponding to P703P was observed. To assure specificity, lysates from HEK293 cells stably transfected with a control plasmid were also tested and were negative for P703P expression. Other anti-P703P antibodies showed similar results.

Immunohistochemical studies were performed as described above, using anti-P703P monoclonal antibody. P703P was found to be expressed at high levels in normal prostate and prostate tumor tissue but was not detectable in all other tissues tested (breast tumor, lung tumor and normal kidney).

e) Preparation and Characterization of Antibodies against P504S

Full-length P504S (SEQ ID NO: 108) was expressed and purified from bacteria essentially as described above for P501S and employed to raise rabbit monoclonal antibodies using Selected Lymphocyte Antibody Method (SLAM) technology at Immgenics Pharmaceuticals (Vancouver, BC, Canada). The anti-P504S monoclonal antibody 13H4 was shown by Western blot to bind to both expressed recombinant P504S and to native P504S in tumor cells.

Immunohistochemical studies using 13H4 to assess P504S expression in various prostate tissues were performed as described above. A total of 104 cases, including 65 cases of radical prostatectomies with prostate cancer (PC), 26 cases of prostate biopsies and 13 cases of benign prostate hyperplasia (BPH), were stained with the anti-P504S monoclonal antibody 13H4. P504S showed strongly cytoplasmic granular staining in 64/65 (98.5%) of PCs in prostatectomies and 26/26 (100%) of PCs in prostatic biopsies. P504S was stained strongly and diffusely in carcinomas (4+ in 91.2% of cases of PC; 3+ in 5.5%; 2+ in 2.2% and 1+ in 1.1%) and high grade prostatic intraepithelial neoplasia (4+ in all cases). The expression of P504S did not vary with Gleason score. Only 17/91 (18.7%) of cases of NP/BPH around PC and 2/13 (15.4%) of BPH cases were focally (1+, no 2+ to 4+ in all cases) and weakly positive for P504S in large glands. Expression of P504S was not found in small atrophic glands, postatrophic hyperplasia, basal cell hyperplasia and transitional cell metaplasia in either biopsies or prostatectomies. P504S was thus found to be over-expressed in all Gleason scores of prostate cancer (98.5 to 100% of sensitivity) and exhibited only focal positivities in large normal glands in 19/104 of cases (82.3% of specificity). These findings indicate that P504S may be usefully employed for the diagnosis of prostate cancer.

Example 19

Characterization of Cell Surface Expression and Chromosome Localization of the Prostate-specific Antigen P501S This example describes studies demonstrating that the prostate-specific antigen P501S is expressed on the surface of cells, together with studies to determine the probable chromosomal location of P501S.

The protein P501S (SEQ ID NO: 113) is predicted to have 11 transmembrane domains. Based on the discovery that the epitope recognized by the anti-P501S monoclonal antibody 10E3-G4-D3 (described above in Example 17) is intracellular, it was predicted that following transmembrane determinants would allow the prediction of extracellular domains of P501S. FIG. 9 is a schematic representation of the P501S protein showing the predicted location of the transmembrane domains and the intracellular epitope described in Example 17. Underlined sequence represents the predicted transmembrane domains, bold sequence represents the predicted extracellular domains, and italicized sequence represents the predicted intracellular domains. Sequence that is both bold and underlined represents sequence employed to generate polyclonal rabbit serum. The location of the transmembrane domains was predicted using HHMTOP as described by Tusnady and Simon (Principles Governing Amino Acid Composition of Integral Membrane Proteins: Applications to Topology Prediction, *J. Mol. Biol.* 283:489–506, 1998).

Based on FIG. 9, the P501S domain flanked by the transmembrane domains corresponding to amino acids 274–295 and 323–342 is predicted to be extracellular. The peptide of SEQ ID NO: 518 corresponds to amino acids 306–320 of P501S and lies in the predicted extracellular domain. The peptide of SEQ ID NO: 519, which is identical to the peptide of SEQ ID NO: 518 with the exception of the substitution of the histidine with an asparginine, was synthesized as described above. A Cys-Gly was added to the C-terminus of the peptide to facilitate conjugation to the carrier protein. Cleavage of the peptide from the solid support was carried out using the following cleavage mixture: trifluoroacetic acid:ethanediol:thioanisol:water:phenol (40:1:2:2:3). After cleaving for two hours, the peptide was precipitated in cold ether. The peptide pellet was then dissolved in 10% v/v acetic acid and lyophilized prior to purification by C18 reverse phase hplc. A gradient of 5–60% acetonitrile (containing 0.05% TFA) in water (containing 0.05% TFA) was used to elute the peptide. The purity of the peptide was verified by hplc and mass spectrometry, and was determined to be >95%. The purified peptide was used to generate rabbit polyclonal antisera as described above.

Surface expression of P501S was examined by FACS analysis. Cells were stained with the polyclonal anti-P501S peptide serum at 10 µg/ml, washed, incubated with a secondary FITC-conjugated goat anti-rabbit Ig antibody (ICN), washed and analyzed for FITC fluorescence using an Excalibur fluorescence activated cell sorter. For FACS analysis of transduced cells, B-LCL were retrovirally transduced with P501S. To demonstrate specificity in these assays, B-LCL transduced with an irrelevant antigen (P703P) or nontransduced were stained in parallel. For FACS analysis of prostate tumor cell lines, Lncap, PC-3 and DU-145 were utilized. Prostate tumor cell lines were dissociated from tissue culture plates using cell dissociation medium and stained as above. All samples were treated with propidium iodide (PI) prior to FACS analysis, and data was obtained from PI-excluding (i.e., intact and non-permeabilized) cells. The rabbit polyclonal serum generated against the peptide of SEQ ID NO: 519 was shown to specifically recognize the surface of cells transduced to express P501S, demonstrating that the epitope recognized by the polyclonal serum is extracellular.

To determine biochemically if P501S is expressed on the cell surface, peripheral membranes from Lncap cells were isolated and subjected to Western blot analysis. Specifically, Lncap cells were lysed using a dounce homogenizer in 5 ml of homogenization buffer (250 mM sucrose, 10 mM HEPES, 1 mM EDTA, pH 8.0, 1 complete protease inhibitor tablet (Boehringer Mannheim)). Lysate samples were spun at 1000 g for 5 min at 4° C. The supernatant was then spun at 8000 g for 10 min at 4° C. Supernatant from the 8000 g spin was recovered and subjected to a 100,000 g spin for 30 min at 4° C. to recover peripheral membrane. Samples were then separated by SDS-PAGE and Western blotted with the mouse monoclonal antibody 10E3-G4-D3 (described above in Example 17) using conditions described above. Recombinant purified P501S, as well as HEK293 cells transfected with and over-expressing P501S were included as positive controls for P501S detection. LCL cell lysate was included as a negative control. P501S could be detected in Lncap total cell lysate, the 8000 g (internal membrane) fraction and also in the 100,000 g (plasma membrane) fraction. These results indicate that P501S is expressed at, and localizes to, the peripheral membrane.

To demonstrate that the rabbit polyclonal antiserum generated to the peptide of SEQ ID NO: 519 specifically recognizes this peptide as well as the corresponding native peptide of SEQ ID NO: 518, ELISA analyses were performed. For these analyses, flat-bottomed 96 well microtiter plates were coated with either the peptide of SEQ ID NO: 519, the longer peptide of SEQ ID NO: 520 that spans the entire predicted extracellular domain, the peptide of SEQ ID NO: 521 which represents the epitope recognized by the P501S-specific antibody 10E3-G4-D3, or a P501S fragment (corresponding to amino acids 355–526 of SEQ ID NO: 113) that does not include the immunizing peptide sequence, at 1 µg/ml for 2 hours at 37° C. Wells were aspirated, blocked with phosphate buffered saline containing 1% (w/v) BSA for 2 hours at room temperature and subsequently washed in PBS containing 0.1% Tween 20 (PBST). Purified anti-P501S polyclonal rabbit serum was added at 2 fold dilutions (1000 ng–125 ng) in PBST and incubated for 30 min at room temperature. This was followed by washing 6 times with PBST and incubating with HRP-conjugated goat anti-rabbit IgG (H+L) Affinipure F(ab') fragment at 1:20000 for 30 min. Plates were then washed and incubated for 15 min in tetramethyl benzidine. Reactions were stopped by the addition of 1N sulfuric acid and plates were read at 450 nm using an ELISA plate reader. As shown in FIG. 11, the anti-P501S polyclonal rabbit serum specifically recognized the peptide of SEQ ID NO: 519 used in the immunization as well as the longer peptide of SEQ ID NO: 520, but did not recognize the irrelevant P501S-derived peptides and fragments.

In further studies, rabbits were immunized with peptides derived from the P501S sequence and predicted to be either extracellular or intracellular, as shown in FIG. 9. Polyclonal rabbit sera were isolated and polyclonal antibodies in the serum were purified, as described above. To determine specific reactivity with P501S, FACS analysis was employed, utilizing either B-LCL transduced with P501S or the irrelevant antigen P703P, of B-LCL infected with vaccinia virus-expressing P501S. For surface expression, dead and non-intact cells were excluded from the analysis as described above. For intracellular staining, cells were fixed and permeabilized as described above. Rabbit polyclonal serum generated against the peptide of SEQ ID NO: 548, which corresponds to amino acids 181–198 of P501S, was found to recognize a surface epitope of P501S. Rabbit polyclonal serum generated against the peptide SEQ ID NO: 551, which corresponds to amino acids 543–553 of P501S, was found to recognize an epitope that was either potentially extracellular or intracellular since in different experiments intact or permeabilized cells were recognized by the polyclonal sera. Based on similar deductive reasoning, the sequences of SEQ ID NO: 541–547, 549 and 550, which correspond to amino acids 109–122, 539–553, 509–520, 37–54, 342–359, 295–323, 217–274, 143–160 and 75–88, respectively, of P501S, can be considered to be potential surface epitopes of P501S recognized by antibodies.

The chromosomal location of P501S was determined using the GeneBridge 4 Radiation Hybrid panel (Research Genetics). The PCR primers of SEQ ID NO: 528 and 529 were employed in PCR with DNA pools from the hybrid panel according to the manufacturer's directions. After 38 cycles of amplification, the reaction products were separated on a 1.2% agarose gel, and the results were analyzed through the Whitehead Institute/MIT Center for Genome Research web server (http://www-genome.wi.mit.edu/cgi-bin/contig/rhmapper.pl) to determine the probable chromosomal location. Using this approach, P501S was mapped to the long arm of chromosome 1 at WI-9641 between q32 and q42. This region of chromosome 1 has been linked to prostate cancer susceptibility in hereditary prostate cancer (Smith et al. *Science* 274:1371–1374, 1996 and Berthon et al. *Am. J. Hum. Genet*. 62:1416–1424, 1998). These results suggest that P501S may play a role in prostate cancer malignancy.

Example 20

Regulation of Expression of the Prostate-specific Antigen P501S

Steroid (androgen) hormone modulation is a common treatment modality in prostate cancer. The expression of a number of prostate tissue-specific antigens have previously been demonstrated to respond to androgen. The responsiveness of the prostate-specific antigen P501S to androgen treatment was examined in a tissue culture system as follows.

Cells from the prostate tumor cell line LNCaP were plated at $1.5 \times 10^6$ cells/T75 flask (for RNA isolation) or $3 \times 10^5$ cells/well of a 6-well plate (for FACS analysis) and grown overnight in RPMI 1640 media containing 10% charcoal-stripped fetal calf serum (BRL Life Technologies, Gaithersburg, Md.). Cell culture was continued for an additional 72 hours in RPMI 1640 media containing 10% charcoal-stripped fetal calf serum, with 1 nM of the synthetic androgen Methyltrienolone (R1881; New England Nuclear) added at various time points. Cells were then harvested for RNA isolation and FACS analysis at 0, 1, 2, 4, 8, 16, 24, 28 and 72-hours post androgen addition. FACS analysis was performed using the anti-P501S antibody 10E3-G4-D3 and permeabilized cells.

For Northern analysis, 5–10 micrograms of total RNA was run on a formaldehyde denaturing gel, transferred to Hybond-N nylon membrane (Amersham Pharmacia Biotech, Piscataway, N.J.), cross-linked and stained with methylene blue. The filter was then prehybridized with Church's Buffer (250 mM $Na_2HPO_4$, 70 mM $H_3PO_4$, 1 mM EDTA, 1% SDS, 1% BSA in pH 7.2) at 65° C. for 1 hour. P501S DNA was labeled with 32P using High Prime random-primed DNA labeling kit (Boehringer Mannheim). Unincorporated label was removed using MicroSpin S300-HR columns (Amersham Pharmacia Biotech). The RNA filter was then hybridized with fresh Church's Buffer containing labeled cDNA overnight, washed with 1×SCP (0.1 M NaCl, 0.03 M $Na_2HPO_4.7H_2O$, 0.001 M $Na_2EDTA$), 1% sarkosyl (n-lauroylsarcosine) and exposed to X-ray film.

Using both FACS and Northern analysis, P501S message and protein levels were found in increase in response to androgen treatment.

Example 20

Preparation of Fusion Proteins of Prostate-specific Antigens

The example describes the preparation of a fusion protein of the prostate-specific antigen P703P and a truncated form of the known prostate antigen PSA. The truncated form of PSA has a 21 amino acid deletion around the active serine site. The expression construct for the fusion protein also has a restriction site at 3' end, immediately prior to the termination codon, to aid in adding cDNA for additional antigens.

The full-length cDNA for PSA was obtained by RT-PCR from a pool of RNA from human prostate tumor tissues using the primers of SEQ ID NO: 607 and 608, and cloned in the vector pCR-Blunt II-TOPO. The resulting cDNA was employed as a template to make two different fragments of PSA by PCR with two sets of primers (SEQ ID NO: 609 and 610; and SEQ ID NO: 611 and 612). The PCR products having the expected size were used as templates to make truncated forms of PSA by PCR with the primers of SEQ ID NO: 611 and 613, which generated PSA (delta 208–218 in amino acids). The cDNA for the mature form of P703P with a 6×histidine tag at the 5' end, was prepared by PCR with P703P and the primers of SEQ ID NO: 614 and 615. The cDNA for the fusion of P703P with the truncated form of PSA (referred to as FOPP) was then obtained by PCR using the modified P703P cDNA and the truncated form of PSA cDNA as templates and the primers of SEQ ID NO: 614 and 615. The FOPP cDNA was cloned into the NdeI site and XhoI site of the expression vector pCRX1, and confirmed by DNA sequencing. The determined cDNA sequence for the fusion construct FOPP is provided in SEQ ID NO: 616, with the amino acid sequence being provided in SEQ ID NO: 617.

The fusion FOPP was expressed as a single recombinant protein in E. coli as follows. The expression plasmid pCRX1FOPP was transformed into the E. coli strain BL21-CodonPlus RIL. The transformant was shown to express FOPP protein upon induction with 1 mM IPTG. The culture of the corresponding expression clone was inoculated into 25 ml LB broth containing 50 ug/ml kanamycin and 34 ug/ml chloramphenicol, grown at 37° C. to OD600 of about 1, and stored at 4° C. overnight. The culture was diluted into 1 liter of TB LB containing 50 ug/ml kanamycin and 34 ug/ml chloramphenicol, and grown at 37° C. to OD600 of 0.4. IPTG was added to a final concentration of 1 mM, and the culture was incubated at 30° C. for 3 hours. The cells were pelleted by centrifugation at 5,000 RPM for 8 min. To purify the protein, the cell pellet was suspended in 25 ml of 10 mM Tris-Cl pH 8.0, 2 mM PMSF, complete protease inhibitor and 15 ug lysozyme. The cells were lysed at 4° C. for 30 minutes, sonicated several times and the lysate centrifuged for 30 minutes at 10,000×g. The precipitate, which contained the inclusion body, was washed twice with 10 mM Tris-Cl pH 8.0 and 1% CHAPS. The inclusion body was dissolved in 40 ml of 10 mM Tris-Cl pH 8.0, 100 mM sodium phosphate and 8 M urea. The solution was bound to 8 ml Ni-NTA (Qiagen) for one hour at room temperature. The mixture was poured into a 25 ml column and washed with 50 ml of 10 mM Tris-Cl pH 6.3, 100 mM sodium phosphate, 0.5% DOC and 8M urea. The bound protein was eluted with 350 mM imidazole, 10 mM Tris-Cl pH 8.0, 100 mM sodium phosphate and 8 M urea. The fractions containing FOPP proteins were combined and dialyzed extensively against 10 mM Tris-Cl pH 4.6, aliquoted and stored at −70° C.

Example 21

Real-time PCR Characterization of the Prostate-specific Antigen P501S in Peripheral Blood of Prostate Cancer Patients Circulating epithelial cells were isolated from fresh blood of normal individuals and metastatic prostate cancer patients, mRNA isolated and cDNA prepared using real-time PCR procedures. Real-time PCR was performed with the Taqman™ procedure using both gene specific primers and probes to determine the levels of gene expression.

Epithelial cells were enriched from blood samples using an immunomagnetic bead separation method (Dynal A. S., Oslo, Norway). Isolated cells were lysed and the magnetic beads removed. The lysate was then processed for poly A+ mRNA isolation using magnetic beads coated with Oligo (dT)25. After washing the beads in buffer, bead/poly A+ RNA samples were suspended in 10 mM Tris HCl pH 8.0 and subjected to reversed transcription. The resulting cDNA was subjected to real-time PCR using gene specific primers. Beta-actin content was also determined and used for normalization. Samples with P501S copies greater than the mean of the normal samples +3 standard deviations were considered positive. Real time PCR on blood samples was performed using the Taqman™ procedure but extending to 50 cycles using forward and reverse primers and probes specific for P501S. Of the eight samples tested, 6 were positive for P501S and β-actin signal. The remaining 2 samples had no detectable β-actin or P501S. No P501S signal was observed in the four normal blood samples tested.

Example 22

Expression of the Prostate-specific Antigens P703P and P501S is Scid Mouse-passaged Prostate Tumors When considering the effectiveness of antigens in the treatment of prostate cancer, the continued presence of the antigens in tumors during androgen ablation therapy is important. The presence of the prostate-specific antigens P703P and P501S in prostate tumor samples grown in SCID mice in the presence of testosterone was evaluated as follows.

Two prostate tumors that had metastasized to the bone were removed from patients, implanted into SCID mice and grown in the presence of testosterone. Tumors were evaluated for mRNA expression of P703P, P501S and PSA using quantitative real time PCR with the SYBR green assay method. Expression of P703P and P501S in a prostate tumor was used as a positive control and the absence in normal intestine and normal heart as negative controls. In both cases, the specific mRNA was present in late passage tumors. Since the bone metastases were grown in the presence of testosterone, this implies that the presence of these genes would not be lost during androgen ablation therapy.

Example 23

Anti-P503S Monoclonl Antibody Inhibits Tumor Growth In Vivo

The ability of the anti-P503S monoclonal antibody 20D4 to suppress tumor formation in mice was examined as follows.

Ten SCID mice were injected subcutaneously with HEK293 cells that expressed P503S. Five mice received 150 micrograms of 20D4 intravenously at day 0 (time of tumor cell injection), day 5 and day 9. Tumor size was measured for 50 days. Of the five animals that received no 20D4, three formed detectable tumors after about 2 weeks which continued to enlarge throughout the study. In contrast, none of the five mice that received 20D4 formed tumors. These results demonstrate that the anti-P503S Mab 20D4 displays potent anti-tumor activity in vivo.

From the foregoing it will be appreciated that, although specific embodiments of the invention have been described herein for purposes of illustration, various modifications may be made without deviating from the spirit and scope of the invention. Accordingly, the invention is not limited except as by the appended claims.

SEQUENCE LISTING (895 sequences)

SEQ ID NO: 1 - DNA, 814 bp, Homo sapien
  misc_feature (1)...(814): n = A,T,C or G
tttttttttttttttcacagtataacagctctttatttctgtgagttctactaggaaatcatcaaatctgagggttgtctggaggacttcaatacacctccccccatagtgaatcagcttccagggggtccagtccctctccttacttcatccccatcccatgccaaaggaagaccctccctccttggctcacagccttctctaggcttcccagtgcctccaggacagagtgggttatgttttcagctccatccttgctgtgagtgtctggtgcgttgtgcctccagcttctgctcagtgcttcatggacagtgtccagcacatgtcactctccactctctcagtgtggatccactagttctagagcggccgccaccgcggtggagctccagcttttgttccctttagtgagggttaattgcgcgcttggcgtaatcatggtcataactgtttcctgtgtgaaattgttatccgctcacaattccacacaacatacgagccggaagcataaagtgtaaagcctggggtgcctaatgagtganctaactcacattaattgcgttgcgctcactgnccgctttccagtcnggaaaactgtcgtgccagctgcattaatgaatcggccaacgcncggggaaaagcggtttgcgttttgggggctcttccgcttctcgctcactnantcctgcgctcggtcnttcggctgcggggaacggtatcactcctcaaaggnggtattacggttatccnnaaatcnggggatacccnggaaaaaantttaacaaaagggcancaaagggcngaaacgtaaaaa

SEQ ID NO: 2 - DNA, 816 bp, Homo sapien
  misc_feature (1)...(816): n = A,T,C or G
acagaaatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcaaagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatccactagttctagaagcggccgccaccgcggtggagctccagcttttgttccctttagtgagggttaattgcgcgcttggcgtaatcatggtcatagctgtttcctgtgtgaaattgttatccgctcacaattcccccaacatacgagccggaacataaagtgttaagcctggggtgcctaatgantgagctaactcncattaattgcgttgcgctcactgcccgctttccagtcgggaaaactgtcgtgccactgcnttantgaatcngccaccccccgggaaaaggcggttgcnttttgggcctcttccgctttcctcgctcattgatcctngcncccggtcttcggctgcggngaacggttcactcctcaaaggcggtntnccggttatccccaaacnggggatacccnga

SEQ ID NO: 3 - DNA, 773 bp, Homo sapien
  misc_feature (1)...(773): n = A,T,C or G
cttttgaaagaagggatggctggggtgtttaacagcagaggtgcagggcgggggctcacgtcctgctcctcactggtgataaacgagccccgttccttgttgtgatcatgatgaacaacctcctcaaaagtcagaaccggagtcacacaggcatctgtgccgtcaaagatttgacaccactctgccttcgtcttctttgcaaatacatctgcaaacttcttcttcatttctggccaatcatccatgctcatctgattgggaagttcatcagactttagtccanntcctttgatcagcagctcgtagaactggggttctattgctccaacagccatgaattccccatctgctgtcctgtaagtcgtatagaaaggtgctccaccatccaacatgttctgtcctcgagggggggcccggtacccaattcgccctatantgagtcgtattacgcgcgctcactggccgtcgttttacaacgtcgtgactgggaaaaccctgggcgttaccaacttaatcgccttgcagcacatccccctttcgccagctgggcgtaatancgaaaaggcccgcaccgatcgcccttccaacagttgcgcacctgaatgggnaaatgggacccccctgttaccgcgcattnaacccccgcngggtttngttgttacccccacntnnaccgcttacactttgccagcgccttancgcccgctccctttcncctttcttcccttcctttcncnccnctttcccccggggtttcccccntcaaaccccna

SEQ ID NO: 4 - DNA, 828 bp, Homo sapien
  misc_feature (1)...(828): n = A,T,C or G
cctcctgagtcctactgacctgtgctttctggtgtggagtccagggctgctaggaaaaggaatgggcagacacaggtgtatgccaatgtttctgaaatgggtataatttcgtcctctccttcggaacactggctgtctctgaagacttctcgctcagtttcagtgaggacacacacaaagacgtgggtgaccatgttgtttgtggggtgcagagatgggaggggtggggcccaccctggaagagtggacagtgacacaaggtggacactctctacagatcactgaggataagctggagccacaatgcatgaggcacacacacagcaaggatgacnctgtaaacatagcccacgctgtcctgngggcactgggaagcctanatnaggccgtgagcanaaagaaggggaggatccactagttctanagcggccgccaccgcggtgganctccancttttgttccctttagtgagggttaattgcgcgcttggcntaatcatggtcatanctntttcctgtgtgaaattgttatccgctcacaattccacacaacatacganccggaaacataaantgtaaacctggggtgcctaatgantgactaactcacattaattgcgttgcgctcactgcccgctttccaatcnggaaacctgtcttgccncttgcattnatgaatcngccaacccccggggaaaagcgtttgcgttttgggcgctcttccgcttcctcnctcanttantccctncnctcggtcattccggctgcngcaaaccggttcaccncctccaaagggggtattccggtttccccnaatccgggganancc

SEQ ID NO: 5 - DNA, 834 bp, Homo sapien
  misc_feature (1)...(834): n = A,T,C or G
tttttttttttttttactgatagatggaatttattaagcttttcacatgtgatagcacatagttttaattgcatccaaagtactaacaaaaactctagcaatcaagaatggcagcatgttattttataacaatcaacacctgtggcttttaaaatttggttttcataagataatttatactgaagtaaatctagccatgcttttaaaaaatgctttaggtcactccaagcttggcagttaacatttggcataaacaataataaaacaatcacaatttaataaataacaaatacaacattgtaggccataatcatatacagtataaggaaaaggtggtagtgttgagtaagcagttattagaatagaataccttggcctctatgcaaatatgtctagacactttgattcactcagccctgacattcagttttcaaagtaggagacaggttctacagtatcattttacagtttccaacacattgaaaacaagtagaaaatgatgagttgatttttattaatgcattacatcctcaagagttatcaccaacccctcagttataaaaaattttcaagttatattagtcatataacttggtgtgcttattttaaattagtgctaaatggattaagtgaagacaacaatggtcccctaatgtgattgatattggtcatttttaccagcttctaaatctnaactttcaggcttttgaactggaacattgnatnacagtgttccanagttncaacctactggaacattacagtgtgcttgattcaaaatgttattttgttaaaaattaaattttaacctggtggaaaaataatttgaaatna

SEQ ID NO: 6 - DNA, 818 bp, Homo sapien
  misc_feature (1)...(818): n = A,T,C or G
ttttttttttttttttttttaagaccctcatcaatagatggagacatacagaaatagtcaaaccacatctacaaaatgccagtatcaggcggcggcttcgaagccaaagtgatgtttggatgtaaagtgaaatattagttggcggatgaagcagatagtgaggaaagttgagccaataatgacgtgaagtccgtggaagcctgtggctacaaaaaatgttgagccgtagatgccgtcggaaatggtgaagggagactcgaagtactctgaggcttgtaggagggtaaaatagagacccagtaaaattgtaataagcagtgcttgaattatttggtttcggttgttttctattagactatggtgagctcaggtgattgatactcctgatgcgagtaatacggatgtgtttaggagtgggacttctaggggatttagcggggtgatgcctgttgggggccagtgccctcctagttggggggtaggggctaggctggagtggtaaaaggctcagaaaaatcctgcgaagaaaaaaacttctgaggtaataaataggattatcccgtatcgaaggcctttttggacaggtggtgtgtggtggccttggtatgtgctttctcgtgttacatcgcgccatcattggtatatggttagtgtgttgggttantanggcctantatgaagaacttttggantggaattaaatcaatngcttggccggaagtcattanganggctnaaaaggccctgttangggtctgggctnggttttacccnacccatggaatncnccccccggacnantgnatccctattcttaa

SEQ ID NO: 7 - DNA, 817 bp, Homo sapien
  misc_feature (1)...(817): n = A,T,C or G
tttttttttttttttttttttggctctagagggggtagagggggtgctatagggtaaatacgggccctatttcaaagatttttaggggaattaattctaggacgatgggtatgaaactgtggtttgctccacagatttcagagcattgaccgtagtatacccccggtcgtgtagcggtgaaagtggtttggtttagacgtccgggaattgcatctgtttttaagcctaatgtggggacagctcatgagtgcaagacgtcttgtgatgtaattattatacnaatgggggcttcaatcgggagtactactcgattgtcaacgtcaaggagtcgcaggtcgcctggttctaggaataatgggggaagtatgtaggaattgaagattaatccgccgtagtcggtgttctcctaggttcaataccattggtggccaattgatttgatggtaaggggagggatcgttgaactcgtctgttatgtaaaggatnccttngggatgggaaggcnatnaaggactanggatnaatggcgggcangatatttcaaacngtctctanttcctgaaacgtctgaaatgttaataanaattaantttngttattgaatnttnnggaaaagggcttacaggactagaaaccaaatangaaaantaatnntaanggcnttatcntnaaaggtnataaccnctcctatnatcccacccaatngnattccccacncnnacnattggatnccccanttccanaaanggccnccccccggtgnannccnccttttgttcccttnantganggttattcncccctngcnttatcancc

SEQ ID NO: 8 - DNA, 799 bp, Homo sapien
  misc_feature (1)...(799): n = A,T,C or G
catttccgggtttactttctaaggaaagccgagcggaagctgctaacgtgggaatcggtgcataaggagaactttctgctggcacgcgctagggacaagcgggagagcgactccgagcgtctgaagcgcacgtcccagaaggtggacttggcactgaaacagctgggacacatccgcgagtacgaacagcgcctgaaagtgctggagcgggaggtccagcagtgtagccgcgtcctggggtgggtggccgangcctganccgctctgccttgctgcccccangtgggccgccaccccctgacctgcctgggtccaaacactgagccctgctggcggacttcaagganaacccccacanggggattttgctcctanantaaggctcatctgggcctcggcccccccacctggttggccttgtctttgangtgagccccatgtccatctgggccactgtcnggaccacctttngggagtgttctccttacaaccacannatgcccggctcctcccggaaaccantcccancctgngaaggatcaagncctgnatccactnntnctanaaccggccnccnccgcngtggaacccnccttntgttccttttcnttnagggttaatnncgccttggccttnccanngtcctncncnttttccnntgttnaaattgttangcncccnccnntcccncnncnncnancccgacccnnannttnnannncctgggggtnccnncngattgacccnnccnccctntanttgcnttngggnncnntgcccctttccctctnggganncg

SEQ ID NO: 9 - DNA, 801 bp, Homo sapien
  misc_feature (1)...(801): n = A,T,C or G
acgccttgatcctcccaggctgggactggttctgggaggagccgggcatgctgtggtttgtaangatgacactcccaaaggtggtcctgacagtggcccagatggacatggggctcacctcaaggacaaggccaccaggtgcgggggccgaagcccacatgatccttactctatgagcaaaatcccctgtgggggcttctccttgaagtccgccancagggctcagtctttggacccangcaggtcatggggttgtngnccaactgggggccncaacgcaaaanggcncagggcctcngncacccatcccangacgcggctacactnctggacctcccnctccaccactttcatgcgctgttcntacccgcgnatntgtcccanctgtttcngtgccnactccancttctnggacgtgcgctacatacgcccggantcncnctcccgctttgtccctatccacgtnccancaacaaatttcnccntantgcaccnattcccacntttnncagntttccncnncgngcttccttntaaaagggttganccccggaaaatnccccaaagggggggggccnggtacccaactnccccctnatagctgaantccccatnaccnngnctcnatgganccntccnttttaannacnttctnaacttgggaananccctcgnccntncccccnttaatcccnccttgcnangnncntcccccnntccncccnnntnggcntntnanncnaaaaaggcccnnnancaatctcctnncncctcanttcgccanccctcgaaatcggccnc

SEQ ID NO: 10 - DNA, 789 bp, Homo sapien
  misc_feature (1)...(789): n = A,T,C or G
cagtctatntggccagtgtggcagctttccctgtggctgccggtgccacatgcctgtcccacagtgtggccgtggtgacagcttcagccgccctcaccgggttcaccttctcagccctgcagatcctgccctacacactggcctccctctaccaccgggagaagcaggtgttcctgcccaaataccgaggggacactggaggtgctagcagtgaggacagcctgatgaccagcttcctgccaggccctaagcctggagctcccttccctaatggacacgtgggtgctggaggcagtggcctgctcccacctccacccgcgctctgcggggcctctgcctgtgatgtctccgtacgtgtggtggtgggtgagcccaccgangccagggtggttccgggccggggcatctgcctggacctcgccatcctggatagtgcttcctgctgtcccangtggccccatccctgtttatgggctccattgtccagctcagccagtctgtcactgcctatatggtgtctgccgcaggcctgggtctggtcccatttactttgctacacaggtantatttgacaagaacganttggccaaatactcagcgttaaaaaattccagcaacattgggggtggaaggcctgcctcactgggtccaactccccgctcctgttaaccccatggggctgccggcttggccgccaatttctgttgctgccaaantnatgtggctctctgctgccacctgttgctggctgaagtgcntacngcncanctnggggggtngggngttccc

SEQ ID NO: 11 - DNA, 772 bp, Homo sapien
  misc_feature (1)...(772): n = A,T,C or G
cccaccctacccaaatattagacaccaacacagaaaagctagcaatggattcccttctactttgttaaataaataagttaaatatttaaatgcctgtgtctctgtgatggcaacagaaggaccaacaggccacatcctgataaaaggtaagaggggggtggatcagcaaaaagacagtgctgtgggctgaggggacctggttcttgtgtgttgcccctcaggactcttcccctacaaataactttcatatgttcaaatcccatggaggagtgtttcatcctagaaactcccatgcaagagctacattaaacgaagctgcaggttaaggggcttanagatgggaaaccaggtgactgagtttattcagctcccaaaaacccttctctaggtgtgtctcaactaggaggctagctgttaaccctgagcctgggtaatccacctgcagagtccccgcattccagtgcatggaacccttctggcctccctgtataagtccagactgaaacccccttggaaggnctccagtcaggcagccctanaaactggggaaaaaagaaaaggacgccccancccccagctgtgcanctacgcacctcaacagcacagggtggcagcaaaaaaaccactttactttggcacaaacaaaaactngggggggcaaccccggcaccccnangggggttaacaggaancngggnaacntggaacccaattnaggcaggcccnccaccccnaatnttgctgggaaatttttcctcccctaaattntttc

SEQ ID NO: 12 - DNA, 751 bp, Homo sapien
  misc_feature (1)...(751): n = A,T,C or G
gccccaattccagctgccacaccacccacggtgactgcattagttcggatgtcatacaaaagctgattgaagcaaccctctactttttggtcgtgagccttttgcttggtgcaggtttcattggctgtgttggtgacgttgtcattgcaacagaatgggggaaaggcactgttctctttgaagtanggtgagtcctcaaaatccgtatagttggtgaagccacagcacttgagccctttcatggtggtgttccacacttgagtgaagtcttcctgggaaccataatctttcttgatggcaggcactaccagcaacgtcagggaagtgctcagccattgtggtgtacaccaaggcgaccacagcagctgcnacctcagcaatgaagatgangaggangatgaagaagaacgtcncgagggcacacttgctctcagtcttancaccatancagcccntgaaaaccaanancaaagaccacnacnccggctgcgatgaagaaatnaccccncgttgacaaacttgcatggcactggganccacagtggcccnaaaaatcttcaaaaaggatgccccatcnattgaccccccaaatgcccactgccaacaggggctgccccacncncnnaacgatganccnattgnacaagatctncntggtcttnatnaacntgaaccctgcntngtggctcctgttcaggnccnnggcctgacttctnaannaangaactcngaagnccccacnggananncg

SEQ ID NO: 13 - DNA, 729 bp, Homo sapien
  misc_feature (1)...(729): n = A,T,C or G
gagccaggcgtccctctgcctgcccactcagtggcaacacccgggagctgttttgtcctttgtggancctcagcagtnccctctttcagaactcantgccaaganccctgaacaggagccaccatgcagtgcttcagcttcattaagaccatgatgatcctcttcaatttgctcatctttctgtgtggtgcagccctgttggcagtgggcatctgggtgtcaatcgatggggcatcctttctgaagatcttcgggccactgtcgtccagtgccatgcagtttgtcaacgtgggctacttcctcatcgcagccggcgttgtggtcttagctctaggtttcctgggctgctatggtgctaagactgagagcaagtgtgccctcgtgacgttcttcttcatcctcctcctcatcttcattgctgaggttgcaatgctgtggtcgccttggtgtacaccacaatggctgagcacttcctgacgttgctggtaatgcctgccatcaanaaaagattatgggttcccaggaanacttcactcaagtgttggaacaccaccatgaaagggctcaagtgctgtggcttcnnccaactatacggattttgaagantcacctacttcaaagaaaanagtgcctttcccccatttctgttgcaattgacaaacgtccccaacacagccaattgaaaacctgcacccaacccaaangggtccccaaccanaaattnaaggg

SEQ ID NO: 14 - DNA, 816 bp, Homo sapien
  misc_feature (1)...(816): n = A,T,C or G
tgctcttcctcaaagttgttcttgttgccataacaaccaccataggtaaagcgggcgcagtgttcgctgaaggggttgtagtaccagcgcgggatgctctccttgcagagtcctgtgtctggcaggtccacgcagtgccctttgtcactggggaaatggatgcgctggagctcgtcaaagccactcgtgtatttttcacaggcagcctcgtccgacgcgtcggggcagttgggggtgtcttcacactccaggaaactgtcnatgcagcagccattgctgcagcggaactgggtgggctgacangtgccagagcacactggatggcgcctttccatgnnangggccctgngggaaagtccctganccccananctgcctctcaaangccccaccttgcacaccccgacaggctagaatggaatcttcttcccgaaaggtagttnttcttgttgcccaanccanccccntaaacaaactcttgcanatctgctccgngggggtcntantaccancgtgggaaaagaaccccaggcngcgaaccaancttgtttggatncgaagcnataatctnctnttctgcttggtggacagcaccantnactgtnnanctttagnccntggtcctcntgggttgnncttgaacctaatcnccnntcaactgggacaaggtaantngccntcctttnaattcccnancntnccccctggtttggggttttncncnctcctaccccagaaannccgtgttcccccccaactaggggccnaaaccnnttnttccacaaccctnccccacccacgggttcngntggttng

SEQ ID NO: 15 - DNA, 783 bp, Homo sapien
  misc_feature (1)...(783): n = A,T,C or G
ccaaggcctgggcaggcatanacttgaaggtacaaccccaggaacccctggtgctgaaggatgtggaaaacacagattggcgcctactgcggggtgacacggatgtcagggtagagaggaaagacccaaaccaggtggaactgtggggactcaaggaangcacctacctgttccagctgacagtgactagctcagaccacccagaggacacggccaacgtcacagtcactgtgctgtccaccaagcagacagaagactactgcctcgcatccaacaangtgggtcgctgccggggctctttcccacgctggtactatgaccccacggagcagatctgcaagagtttcgtttatggaggctgcttgggcaacaagaacaactaccttcgggaagaagagtgcattctancctgtcngggtgtgcaaggtgggcctttganangcanctctggggctcangcgactttcccccagggcccctccatggaaaggcgccatccantgttctctggcacctgtcagcccacccagttccgctgcancaatggctgctgcatcnacantttcctngaattgtgacaacaccccccantgcccccaaccctcccaacaaagcttccctgttnaaaaatacnccanttggcttttnacaaacncccggcncctccnttttccccnntnaacaaagggcnctngcntttgaactgcccnaacccnggaatctnccnnggaaaaantnccccccctggttcctnnaancccctccncnaaanctncccccccc

SEQ ID NO: 16 - DNA, 801 bp, Homo sapien
  misc_feature (1)...(801): n = A,T,C or G
gccccaattccagctgccacaccacccacggtgactgcattagttcggatgtcatacaaaagctgattgaagcaaccctctactttttggtcgtgagccttttgcttggtgcaggtttcattggctgtgttggtgacgttgtcattgcaacagaatgggggaaaggcactgttctctttgaagtagggtgagtcctcaaaatccgtatagttggtgaagccacagcacttgagccctttcatggtggtgttccacacttgagtgaagtcttcctgggaaccataatctttcttgatggcaggcactaccagcaacgtcaggaagtgctcagccattgtggtgtacaccaaggcgaccacagcagctgcaacctcagcaatgaagatgaggaggaggatgaagaagaacgtcncgagggcacacttgctctccgtcttagcaccatagcagcccangaaaccaagagcaaagaccacaacgccngctgcgaatgaaagaaantacccacgttgacaaactgcatggccactggacgacagttggcccgaanatcttcagaaaagggatgccccatcgattgaacacccanatgcccactgccnacagggctgcnccncncngaaagaatgagccattgaagaaggatcntcntggtcttaatgaactgaaaccntgcatggtggcccctgttcagggctcttggcagtgaattctganaaaaaggaacngcntnagcccccccaaanganaaaacacccccgggtgttgccctgaattggcggccaagganccctgccccng

SEQ ID NO: 17 - DNA, 740 bp, Homo sapien
  misc_feature (1)...(740): n = A,T,C or G
gtgagagccaggcgtccctctgcctgcccactcagtggcaacacccgggagctgttttgtcctttgtggagcctcagcagttccctctttcagaactcactgccaagagccctgaacaggagccaccatgcagtgcttcagcttcattaagaccatgatgatcctcttcaatttgctcatctttctgtgtggtgcagccctgttggcagtgggcatctgggtgtcaatcgatggggcatcctttctgaagatcttcgggccactgtcgtccagtgccatgcagtttgtcaacgtgggctacttcctcatcgcagccggcgttgtggtctttgctcttggtttcctgggctgctatggtgctaagacggagagcaagtgtgccctcgtgacgttcttcttcatcctcctcctcatcttcattgctgaagttgcagctgctgtggtcgccttggtgtacaccacaatggctgaaccattcctgacgttgctggtantgcctgccatcaanaaagattatgggttcccaggaaaaattcactcaantntggaacaccnccatgaaaagggctccaatttctgntggcttccccaactataccggaattttgaaagantcnccctacttccaaaaaaaaananttgcctttncccccnttctgttgcaatgaaaacntcccaanacngccaatnaaaacctgcccnnncaaaaaggntcncaaacaaaaaaantnnaagggttn

SEQ ID NO: 18 - DNA, 802 bp, Homo sapien
  misc_feature (1)...(802): n = A,T,C or G
ccgctggttgcgctggtccagngnagccacgaagcacgtcagcatacacagcctcaatcacaaggtcttccagctgccgcacattacgcagggcaagagcctccagcaacactgcatatgggatacactttactttagcagccagggtgacaactgagaggtgtcgaagcttattcttctgagcctctgttagtggaggaagattccgggcttcagctaagtagtcagcgtatgtcccataagcaaacactgtgagcagccggaaggtagaggcaaagtcactctcagccagctctctaacattgggcatgtccagcagttctccaaacacgtagacaccagnggcctccagcacctgatggatgagtgtggccagcgctgcccccttggccgacttggctaggagcagaaattgctcctggttctgccctgtcaccttcacttccgcactcatcactgcactgagtgtgggggacttgggctcaggatgtccagagacgtggttccgccccctcncttaatgacaccgnccanncaaccgtcggctcccgccgantgngttcgtcgtncctgggtcagggtctgctggccnctacttgcaancttcgtcnggcccatggaattcaccncaccggaactngtangatccactnnttctataaccggncgccaccgcnnntggaactccactcttnttncctttacttgagggttaaggtcacccttnncgttaccttggtccaaaccntnccntgtgtcganatngtnaatcnggnccnatnccanccncatangaagccng

SEQ ID NO: 19 - DNA, 731 bp, Homo sapien
  misc_feature (1)...(731): n = A,T,C or G
cnaagcttccaggtnacgggccgcnaancctgacccnaggtancanaangcagncngcgggagcccaccgtcacgnggnggngtctttatnggagggggcggagccacatcnctggacntcntgaccccaactccccnccncncantgcagtgatgagtgcagaactgaaggtnacgtggcaggaaccaagancaaannctgctccnntccaagtcggcnnagggggcggggctggccacgcncatccntcnagtgctgnaaagccccnncctgtctacttgtttggagaacngcnnngacatgcccagngttanataacnggcngagagtnantttgcctctcccttccggctgcgcancgngtntgcttagnggacataacctgactacttaactgaacccnngaatctnccncccctccactaagctcagaacaaaaaacttcgacaccactcanttgtcacctgnctgctcaagtaaagtgtaccccatncccaatgtntgctngangctctgncctgcnttangttcggtcctgggaagacctatcaattnaagctatgtttctgactgcctcttgctccctgnaacaancnacccnncnntccaagggggggncggcccccaatccccccaaccntnaattnantttanccccncccccnggcccggccttttacnancntcnnnnacngggnaaaaccnnngctttncccaacnnaatccncct

SEQ ID NO: 20 - DNA, 754 bp, Homo sapien
  misc_feature (1)...(754): n = A,T,C or G
tttttttttttttttttttttaaaaaccccctccattnaatgnaaacttccgaaattgtccaaccccctcntccaaatnnccntttccgggngggggttccaaacccaanttanntttggannttaaattaaatnttnnttggnggnnnaanccnaatgtnangaaagttnaacccantatnancttnaatncctggaaaccngtngnttccaaaaatntttaacccttaantccctccgaaatngttnanggaaaacccaanttctcntaaggttgtttgaaggntnaatnaaaancccnnccaattgtttttngccacgcctgaattaattggnttccgntgttttccnttaaaanaaggnnanccccggttantnaatccccccnnccccaattataccgantttttttngaattgggancccncgggaattaacggggnnnntccctnttggggggcnggnnccccccccntcgggggttngggncaggncnnaattgtttaagggtccgaaaaatccctccnagaaaaaaanctcccaggntgagnntngggtttnccccccccccanggcccctctcgnanagttggggtttggggggcctgggattttntttcccctnttncctcccccccccccnggganagaggttngngttttgntcnncggccccnccnaaganctttnccganttnanttaaatccntgcctnggcgaagtccnttgnagggntaaanggccccctnncggg

SEQ ID NO: 21 - DNA, 755 bp, Homo sapien
  misc_feature (1)...(755): n = A,T,C or G
atcancccatgaccccnaacnngggaccnctcanccggncnnncnaccnccggccnatcanngtnagnncactncnnttnnatcacnccccnccnactacgcccncnanccnacgcnctanncanatnccactganngcgcgangtnganngagaaanctnataccanagncaccanacnccagctgtccnanaangcctnnnatacnggnnnatccaatntgnancctccnaagtattnnncnncanatgattttcctnanccgattacccntnccccctancccctcccccccaacnacgaaggcnctggnccnaaggnngcgncnccccgctagntccccnncaagtcncncncctaaactcanccnnattacncgcttcntgagtatcactccccgaatctcaccctactcaactcaaaaanatcngatacaaaataatncaagcctgnttatnacactntgactgggtctctattttagnggtccntnaancntcctaatacttccagtctnccttcnccaatttccnaanggctctttcngacagcatnttttggttcccnnttgggttcttanngaattgcccttcntngaacgggctcntcttttccttcggttancctggnttcnnccggccagttattatttcccnttttaaattcntnccntttanttttggcnttcnaaacccccggccttgaaaacggccccctggtaaaaggttgttttganaaaatttttgttttgttcc

SEQ ID NO: 22 - DNA, 849 bp, Homo sapien
  misc_feature (1)...(849): n = A,T,C or G
tttttttttttttttangtgtngtcgtgcaggtagaggcttactacaantgtgaanacgtacgctnggantaangcgacccganttctagganncnccctaaaatcanactgtgaagatnatcctgnnnacggaanggtcaccggnngatnntgctagggtgnccnctcccannncnttncataactcngnggccctgcccaccaccttcggcggcccngngnccgggcccgggtcattngnnttaaccncactnngcnancggtttccnnccccnncngacccnggcgatccggggtnctctgtcttcccctgnagncnanaaantgggccncggncccctttacccctnnacaagccacngccntctanccncngccccccctccantnngggggactgccnanngctccgttnctngnnaccccnnngggtncctcggttgtcgantcnaccgnangccanggattccnaaggaaggtgcgttnttggcccctacccttcgctncggnncacccttcccgacnanganccgctcccgcncnncgnngcctcncctcgcaacacccgcnctcntcngtncggnnncccccccacccgcnccctcncncngncgnancnctccnccnccgtctcanncaccaccccgccccgccaggccntcanccacnggnngacnngnagcncnntcgcnccgcgcngcgncnccctcgccncngaactncntcnggccantnncgctcaanccnnacnaaacgccgctgcgcggcccgnagcgnccncctccncgagtcctcccgncttccnacccangnnttccncgaggacacnnnaccccgccnncangcgg

SEQ ID NO: 23 - DNA, 872 bp, Homo sapien
  misc_feature (1)...(872): n = A,T,C or G
gcgcaaactatacttcgctcgnactcgtgcgcctcgctnctcttttcctccgcaaccatgtctgacnancccgattnggcngatatcnanaagntcgancagtccaaactgantaacacacacacncnanaganaaatccnctgccttccanagtanacnattgaacnngagaaccangcnggcgaatcgtaatnaggcgtgcgccgccaatntgtcnccgtttattntnccagcntcncctnccnaccctacntcttcnnagctgtcnnacccctngtncgnaccccccnaggtcgggatcgggtttnnnntgaccgngcnncccctccccccntccatnacganccncccgcaccaccnanngcncgcnccccgnnctcttcgccnccctgtcctntncccctgtngcctggcncngnaccgcattgaccctcgccnnctncnngaaancgnanacgtccgggttgnnannancgctgtgggnnngcgtctgcnccgcgttccttccnncnncttccaccatcttcnttacngggtctccncgccntctcnnncacnccctgggacgctntcctntgccccccttnactcccccccttcgncgtgncccgnccccaccntcatttncanacgntcttcacaannncctggntnnctcccnancngncngtcanccnagggaagggnggggnnccnntgnttgacgttgnggngangtccgaanantcctcnccntcancnctacccctcgggcgnnctctcngttnccaacttancaantctcccccgngngcncntctcagcctcncccnccccnctctctgcantgtnctctgctctnaccnntacgantnttcgncnccctctttcc

SEQ ID NO: 24 - DNA, 815 bp, Homo sapien
  misc_feature (1)...(815): n = A,T,C or G
gcatgcaagcttgagtattctatagngtcacctaaatancttggcntaatcatggtcntanctgncttcctgtgtcaaatgtatacnaantanatatgaatctnatntgacaaganngtatcntncattagtaacaantgtnntgtccatcctgtcngancanattcccatnnattncgncgcattcncngcncantatntaatngggaantcnnntnnnncaccnncatctatcntnccgcnccctgactggnagagatggatnanttctnntntgaccnacatgttcatcttggattnaananccccccgcngnccaccggttngnngcnagccnntcccaagacctcctgtggaggtaacctgcgtcaganncatcaaacntgggaaacccgcnnccangtnnaagtngnnncanangatcccgtccaggnttnaccatcccttcncagcgccccctttngtgccttanagngnagcgtgtccnanccnctcaacatganacgcgccagnccanccgcaattnggcacaatgtcgncgaaccccctagggggantnatncaaanccccaggattgtccncncangaaatcccncanccccnccctacccnnctttgggacngtgaccaantcccggagtnccagtccggccngnctcccccaccggtnnccntgggggggtgaanctcngnntcanccngncgaggnntcgnaaggaaccggncctnggncgaanngancnntcngaagngccncntcgtataaccccccctcnccanccnacngntagntcccccccngggtncggaangg

SEQ ID NO: 25 - DNA, 775 bp, Homo sapien
  misc_feature (1)...(775): n = A,T,C or G
ccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaanttgacttactgaagaatgganagagaattgaaaaagtggagcattcagacttgtctttcagcaaggactggtctttctatctcntgtactacactgaattcacccccactgaaaaagatgagtatgcctgccgtgtgaaccatgtgactttgtcacagcccaagatagttaagtgggatcgagacatgtaagcagncnncatggaagtttgaagatgccgcatttggattggatgaattccaaattctgcttgcttgcnttttaatantgatatgcntatacaccctaccctttatgnccccaaattgtaggggttacatnantgttcncntnggacatgatcttcctttataantccnccnttcgaattgcccgtcncccngttnngaatgtttccnnaaccacggttggctcccccaggtcncctcttacggaagggcctgggccnctttncaaggttgggggaaccnaaaatttcncttntgcccncccnccacnntcttgngnncncantttggaacccttccnattccccttggcctcnnanccttnnctaanaaaacttnaaancgtngcnaaanntttnacttccccccttacc

SEQ ID NO: 26 - DNA, 820 bp, Homo sapien
  misc_feature (1)...(820): n = A,T,C or G
anattantacagtgtaatcttttcccagaggtgtgtanagggaacggggcctagaggcatcccanagatancttatancaacagtgctttgaccaagagctgctgggcacatttcctgcagaaaaggtggcggtccccatcactcctcctctcccatagccatcccagaggggtgagtagccatcangccttcggtgggagggagtcanggaaacaacanaccacagagcanacagaccantgatgaccatgggcgggagcgagcctcttccctgnaccggggtggcananganagcctanctgaggggtcacactataaacgttaacgaccnagatnancacctgcttcaagtgcacccttcctacctgacnaccagngaccnnnaactgcngcctggggacagcnctgggancagctaacnnagcactcacctgcccccccatggccgtncgcntccctggtcctgncaagggaagctccctgttggaattncgggganaccaaggganccccctcctccanctgtgaaggaaaaanngatggaattttncccttccggccnntcccctcttcctttacacgccccctnntactcntctccctctnttntcctgncncacttttnaccccnnnatttcccttnattgatcggannctnganattccactnncgcctnccntcnatcngnaanacnaaanactntctnacccnggggatgggnncctcgntcatcctctctttttcnctaccnccnnttctttgcctctccttngatcatccaaccntcgntggccntncccccccnnntcctttnccc

SEQ ID NO: 27 - DNA, 818 bp, Homo sapien
  misc_feature (1)...(818): n = A,T,C or G
tctgggtgatggcctcttcctcctcagggacctctgactgctctgggccaaagaatctcttgtttcttctccgagccccaggcagcggtgattcagccctgcccaacctgattctgatgactgcggatgctgtgacggacccaaggggcaaatagggtcccagggtccagggaggggcgcctgctgagcacttccgcccctcaccctgcccagcccctgccatgagctctgggctgggtctccgcctccagggttctgctcttccangcangccancaagtggcgctgggccacactggcttcttcctgccccntccctggctctgantctctgtcttcctgtcctgtgcangcnccttggatctcagtttccctcnctcanngaactctgtttctganntcttcanttaactntgantttatnaccnantggnctgtnctgtcnnactttaatgggccngaccggctaatccctccctcnctcccttccanttcnnnnaaccngcttnccntcntctccccntancccgccngggaancctcctttgccctnaccangggccnnnaccgcccntnnctnggggggcnnggtnnctncncctgntnnccccnctcncnnttncctcgtcccnncnncgcnnngcannttcncngtcccnntnnctcttcnngtntcgnaangntcncntntnnnnngncnngntnntncntccctctcnccnnntgnangtnnttnnnncncngnnccccnnnncnnnnnnggnnntnnntctncncngccccnncccccngnattaaggcctccnntctccggccnc

SEQ ID NO: 28 - DNA, 731 bp, Homo sapien
  misc_feature (1)...(731): n = A,T,C or G
aggaagggcggagggatattgtangggattgagggataggagnataangggggaggtgtgtcccaacatganggtgnngttctcttttgaangagggttgngtttttannccnggtgggtgattnaaccccattgtatggagnnaaaggntttnagggatttttcggctcttatcagtatntanattcctgtnaatcggaaaatnatntttcnncnggaaaatnttgctcccatccgnaaattnctcccgggtagtgcatnttngggggncngccangtttcccaggctgctanaatcgtactaaagnttnaagtgggantncaaatgaaaacctnncacagagnatccntacccgactgtnnnttnccttcgccctntgactctgcnngagcccaatacccnngngnatgtcncccngnnnngcgncnctgaaannnnctcgnggctnngancatcanggggtttcgcatcaaaagcnncgtttcncatnaaggcactttngcctcatccaaccnctngccctcnnccatttngccgtcnggttcncctacgctnntngcncctnnntnganattttncccgcctngggnaancctcctgnaatgggtagggncttntcttttnaccnngnggtntactaatcnnctncacgcntnctttctcnaccccccccctttttcaatcccancggcnaatggggtctccccnncganggggggnnncccanncc

SEQ ID NO: 29 - DNA, 822 bp, Homo sapien
  misc_feature (1)...(822): n = A,T,C or G
actagtccagtgtggtggaattccattgtgttggggncncttctatgantantnttagatcgctcanacctcacancctcccnacnangcctataangaanannaataganctgtncnntatntntacnctcatanncctcnnnacccactccctcttaacccntactgtgcctatngcntnnctantctntgccgcctncnanccaccngtgggccnaccncnngnattctcnatctcctcnccatntngcctanantangtncataccctatacctacnccaatgctannnctaancntccatnanttannntaactaccactgacntngactttcncatnanctcctaatttgaatctactctgactcccacngcctannnattagcancntcccccnacnatntctcaaccaaatcntcaacaacctatctanctgttcnccaaccnttncctccgatccccnnacaacccccctcccaaatacccnccacctgacncctaacccncaccatcccggcaagccnanggncatttanccactggaatcacnatngganaaaaaaaacccnaactctctancncnnatctccctaanaaatnctcctnnaatttactnncantnccatcaancccacntgaaacnnaacccctgtttttanatcccttctttcgaaaaccnaccctttannncccaacctttngggcccccccnctncccnaatgaaggncncccaatcnangaaacgnccntgaaaaancnaggcnaanannntccgcanatcctatcccttanttnggggncccttncccngggcccc

SEQ ID NO: 30 - DNA, 787 bp, Homo sapien
  misc_feature (1)...(787): n = A,T,C or G
cggccgcctgctctggcacatgcctcctgaatggcatcaaaagtgatggactgcccattgctagagaagaccttctctcctactgtcattatggagccctgcagactgagggctccccttgtctgcaggatttgatgtctgaagtcgtggagtgtggcttggagctcctcatctacatnagctggaagccctggagggcctctctcgccagcctcccccttctctccacgctctccanggacaccaggggctccaggcagcccattattcccagnangacatggtgtttctccacgcggacccatggggcctgnaaggccagggtctcctttgacaccatctctcccgtcctgcctggcaggccgtgggatccactanttctanaacggncgccaccncggtgggagctccagcttttgttcccnttaatgaaggttaattgcncgcttggcgtaatcatnggtcanaactntttcctgtgtgaaattgtttntcccctcncnattccncncnacatacnaacccggaancataaagtgttaaagcctgggggtngcctnnngaatnaactnaactcaattaattgcgttggctcatggcccgctttccnttcnggaaaactgtcntcccctgcnttnntgaatcggccaccccccngggaaaagcggtttgcnttttngggggntccttccncttcccccctcnctaanccctncgcctcggtcgttncnggtngcggggaangggnatnnnctcccncnaagggggngagnnngntatccccaaa

SEQ ID NO: 31 - DNA, 799 bp, Homo sapien
  misc_feature (1)...(799): n = A,T,C or G
tttttttttttttttttggcgatgctactgtttaattgcaggaggtgggggtgtgtgtaccatgtaccagggctattagaagcaagaaggaaggagggagggcagagcgccctgctgagcaacaaaggactcctgcagccttctctgtctgtctcttggcgcaggcacatggggaggcctcccgcagggtgggggccaccagtccaggggtgggagcactacanggggtgggagtgggtggtggctggtncnaatggcctgncacanatccctacgattcttgacacctggatttcaccaggggaccttctgttctcccanggnaacttcntnnatctcnaaagaacacaactgtttcttcngcanttctggctgttcatggaaagcacaggtgtccnatttnggctgggacttggtacatatggttccggcccacctctcccntcnaanaagtaattcacccccccccnccntctnttgcctgggcccttaantacccacaccggaactcanttanttattcatcttnggntgggcttgntnatcnccncctgaangcgccaagttgaaaggccacgccgtncccnctccccatagnannttttnncntcanctaatgcccccccnggcaacnatccaatccccccccntgggggccccagcccanggcccccgnctcgggnnnccngncncgnantccccaggntctcccantcngncccnnngcncccccgcacgcagaacanaaggntngagccnccgcannnnnnnggtnncnacctcgccccccccnncgnng

SEQ ID NO: 32 - DNA, 789 bp, Homo sapien
  misc_feature (1)...(789): n = A,T,C or G
ttttttttttttttttttttttttttttttttttttttttttttttttttttttttttttttttnccnagggcaggtttattgacaacctcncgggacacaancaggctggggacaggacggcaacaggctccggcggcggcggcggcggccctacctgcggtaccaaatntgcagcctccgctcccgcttgatnttcctctgcagctgcaggatgccntaaaacagggcctcggccntnggtgggcaccctgggatttnaatttccacgggcacaatgcggtcgcancccctcaccaccnattaggaatagtggtnttacccnccnccgttggcncactccccntggaaaccacttntcgcggctccggcatctggtcttaaaccttgcaaacnctggggccctctttttggttantntnccngccacaatcatnactcagactggcncgggctggccccaaaaaancnccccaaaaccggnccatgtcttnncggggttgctgcnatntncatcacctcccgggcncancaggncaacccaaaagttcttgnggcccncaaaaaanctccggggggncccagtttcaacaaagtcatcccccttggcccccaaatcctccccccgnttnctgggtttgggaacccacgcctctnnctttggnnggcaagntggntcccccttcgggcccccggtgggcccnnctctaangaaaacnccntcctnnncaccatccccccnngnnacgnctancaangnatccctttttttanaaacgggccccccncg

SEQ ID NO: 33 - DNA, 793 bp, Homo sapien
  misc_feature (1)...(793): n = A,T,C or G
gacagaacatgttggatggtggagcacctttctatacgacttacaggacagcagatggggaattcatggctgttggagcaatanaaccccagttctacgagctgctgatcaaaggacttggactaaagtctgatgaacttcccaatcagatgagcatggatgattggccagaaatgaanaagaagtttgcagatgtatttgcaaagaagacgaaggcagagtggtgtcaaatctttgacggcacagatgcctgtgtgactccggttctgacttttgaggaggttgttcatcatgatcacaacaangaacggggctcgtttatcaccantgaggagcaggacgtgagcccccgccctgcacctctgctgttaaacaccccagccatcccttctttcaaaagggatccactacttctagagcggncgccaccgcggtggagctccagcttttgttccctttagtgagggttaattgcgcgcttggcgtaatcatggtcatanctgtttcctgtgtgaaattgttatccgctcacaattccacacaacatacganccggaagcatnaaattttaaagcctggnggtngcctaatgantgaactnactcacattaattggctttgcgctcactgcccgctttccagtccggaaaacctgtccttgccagctgccnttaatgaatcnggccaccccccggggaaaaggcngtttgcttnttggggcgcncttcccgctttctcgcttcctgaantccttccccccggtctttcggcttgcggcnaacggtatcnacct

SEQ ID NO: 34 - DNA, 756 bp, Homo sapien
  misc_feature (1)...(756): n = A,T,C or G
gccgcgaccggcatgtacgagcaactcaagggcgagtggaaccgtaaaagccccaatcttancaagtgcggggaanagctgggtcgactcaagctagttcttctggagctcaacttcttgccaaccacagggaccaagctgaccaaacagcagctaattctggcccgtgacatactggagatcggggcccaatggagcatcctacgcaangacatcccctccttcgagcgctacatggcccagctcaaatgctactactttgattacaangagcagctccccgagtcagcctatatgcaccagctcttgggcctcaacctcctcttcctgctgtcccagaaccgggtggctgantnccacacgganttggancggctgcctgcccaangacatacanaccaatgtctacatcnaccaccagtgtcctggagcaatactgatgganggcagctaccncaaagtnttcctggccnagggtaacatcccccgccgagagctacaccttcttcattgacatcctgctcgacactatcagggatgaaaatcgcngggttgctccagaaaggctncaanaanatccttttcnctgaaggcccccggatncnctagtnctagaatcggcccgccatcgcggtggancctccaacctttcgttnccctttactgagggttnattgccgcccttggcgttatcatggtcacnccngttncctgtgttgaaattnttaaccccccacaattccacgccnacattng

SEQ ID NO: 35 - DNA, 834 bp, Homo sapien
  misc_feature (1)...(834): n = A,T,C or G
ggggatctctanatcnacctgnatgcatggttgtcggtgtggtcgctgtcgatgaanatgaacaggatcttgcccttgaagctctcggctgctgtntttaagttgctcagtctgccgtcatagtcagacacnctcttgggcaaaaaacancaggatntgagtcttgatttcacctccaataatcttcngggctgtctgctcggtgaactcgatgacnangggcagctggttgtgtntgataaantccancangttctccttggtgacctccccttcaaagttgttccggccttcatcaaacttctnnaanangannancccanctttgtcgagctggnatttgganaacacgtcactgttggaaactgatcccaaatggtatgtcatccatcgcctctgctgcctgcaaaaaacttgcttggcncaaatccgactccccntccttgaaagaagccnatcacacccccctccctggactccnncaangactctnccgctnccccntccnngcagggttggtggcannccgggcccntgcgcttcttcagccagttcacnatnttcatcagcccctctgccagctgttntattccttgggggggaanccgtctctcccttcctgaannaactttgaccgtnggaatagccgcgcntcnccntacntnctgggccgggttcaaantccctccnttgncnntcncctcgggccattctggatttnccnaactttttccttcccccnccccncggngtttggntttttcatngggccccaactctgctnttggccantcccctgggggcntntancnccccctntggtcccntngggcc

SEQ ID NO: 36 - DNA, 814 bp, Homo sapien
  misc_feature (1)...(814): n = A,T,C or G
cggncgctttccngccgcgccccgtttccatgacnaaggctcccttcangttaaatacnncctagnaaacattaatgggttgctctactaatacatcatacnaaccagtaagcctgcccanaacgccaactcaggccattcctaccaaaggaagaaaggctggtctctccaccccctgtaggaaaggcctgccttgtaagacaccacaatncggctgaatctnaagtcttgtgttttactaatggaaaaaaaaaataaacaanaggttttgttctcatggctgcccaccgcagcctggcactaaaacancccagcgctcacttctgcttgganaaatattctttgctcttttggacatcaggcttgatggtatcactgccacntttccacccagctgggcncccttcccccatntttgtcantganctggaaggcctgaancttagtctccaaaagtctcngcccacaagaccggccaccaggggangtcntttncagtggatctgccaaanantacccntatcatcnntgaataaaaaggcccctgaacganatgcttccancancctttaagacccataatcctngaaccatggtgcccttccggtctgatccnaaaggaatgttcctgggtcccantccctcctttgttncttacgttgtnttggacccntgctngnatnacccaantganatccccngaagcaccctncccctggcatttgantttcntaaattctctgccctacnnctgaaagcacnattccctnggcnccnaanggngaactcaagaaggtctnngaaaaaccacncn

SEQ ID NO: 37 - DNA, 760 bp, Homo sapien
  misc_feature (1)...(760): n = A,T,C or G
gcatgctgctcttcctcaaagttgttcttgttgccataacaaccaccataggtaaagcgggcgcagtgttcgctgaaggggttgtagtaccagcgcgggatgctctccttgcagagtcctgtgtctggcaggtccacgcaatgccctttgtcactggggaaatggatgcgctggagctcgtcnaanccactcgtgtatttttcacangcagcctcctccgaagcntccgggcagttgggggtgtcgtcacactccactaaactgtcgatncancagcccattgctgcagcggaactgggtgggctgacaggtgccagaacacactggatnggcctttccatggaagggcctgggggaaatcncctnancccaaactgcctctcaaaggccaccttgcacaccccgacaggctagaaatgcactcttcttcccaaaggtagttgttcttgttgcccaagcancctccancaaaccaaaancttgcaaaatctgctccgtgggggtcatnnntaccanggttggggaaanaaacccggcngnganccnccttgtttgaatgcnaaggnaataatcctcctgtcttgcttgggtggaanagcacaattgaactgttaacnttgggccgngttccnctngggtggtctgaaactaatcaccgtcactggaaaaaggtangtgccttccttgaattcccaaanttcccctngntttgggtnntttctcctctnccctaaaaatcgtnttccccccccntanggcg

SEQ ID NO: 38 - DNA, 724 bp, Homo sapien
  misc_feature (1)...(724): n = A,T,C or G
tttttttttttttttttttttttttttttttttttaaaaaccccctccattgaatgaaaacttccnaaattgtccaaccccctcnnccaaatnnccatttccgggggggggttccaaacccaaattaattttggantttaaattaaatnttnattnggggaanaanccaaatgtnaagaaaatttaacccattatnaacttaaatncctngaaacccntggnttccaaaaatttttaacccttaaatccctccgaaattgntaanggaaaaccaaattcncctaaggctntttgaaggttngatttaaacccccttnanttnttttnacccnngnctnaantatttngnttccggtgttttcctnttaancntnggtaactcccgntaatgaannnccctaanccaattaaaccgaattttttttgaattggaaattccnngggaattnaccggggtttttcccntttgggggccatncccccnctttcggggtttgggnntaggttgaatttttnnangncccaaaaaancccccaanaaaaaaactcccaagnnttaattngaatntcccccttcccaggccttttgggaaaggngggtttntgggggccnggganttcnttcccccnttnccnccccccccccnggtaaanggttatngnntttggtttttgggccccttnanggaccttccggatngaaattaaatccccgggncggccg

SEQ ID NO: 39 - DNA, 751 bp, Homo sapien
  misc_feature (1)...(751): n = A,T,C or G
tttttttttttttttctttgctcacatttaatttttattttgattttttttaatgctgcacaacacaatatttatttcatttgtttcttttatttcattttatttgtttgctgctgctgttttatttatttttactgaaagtgagagggaacttttgtggccttttttcctttttctgtaggccgccttaagctttctaaatttggaacatctaagcaagctgaanggaaaagggggtttcgcaaaatcactcgggggaanggaaaggttgctttgttaatcatgccctatggtgggtgattaactgcttgtacaattacntttcacttttaattaattgtgctnaangctttaattanacttgggggttccctccccanaccaaccccnctgacaaaaagtgccngccctcaaatnatgtcccggcnntcnttgaaacacacngcngaangttctcattntccccncnccaggtnaaaatgaagggttaccatntttaacnccacctccacntggcnnngcctgaatcctcnaaaancnccctcaancnaattnctnngccccggtcncgcntnngtcccncccgggctccgggaantncacccccngaanncnntnncnaacnaaattccgaaaatattcccnntcnctcaattcccccnnagactntcctcnncnancncaattttcttttnntcacgaacncgnnccnnaaaatgnnnnncncctccnctngtccnnaatcnccanc

SEQ ID NO: 40 - DNA, 753 bp, Homo sapien
  misc_feature (1)...(753): n = A,T,C or G
gtggtattttctgtaagatcaggtgttcctccctcgtaggtttagaggaaacaccctcatagatgaaaacccccccgagacagcagcactgcaactgccaagcagccggggtaggaggggcgccctatgcacagctgggcccttgagacagcagggcttcgatgtcaggctcgatgtcaatggtctggaagcggcggctgtacctgcgtaggggcacaccgtcagggcccaccaggaacttctcaaagttccaggcaacntcgttgcgacacaccggagaccaggtgatnagcttggggtcggtcataancgcggtggcgtcgtcgctgggagctggcagggcctcccgcaggaaggcnaataaaaggtgcgcccccgcaccgttcanctcgcacttctcnaanaccatgangttgggctcnaacccaccaccannccggacttccttganggaattcccaaatctcttcgntcttgggcttctnctgatgccctanctggttgcccngnatgccaancanccccaanccccggggtcctaaancacccncctcctcntttcatctgggttnttntccccggaccntggttcctctcaagggancccatatctcnaccantactcaccntncccccccntgnnacccanccttctanngnttcccncccgncctctggcccntcaaanangcttncacnacctgggtctgccttcccccctnccctatctgnaccccncntttgtctcantnt

SEQ ID NO: 41 - DNA, 341 bp, Homo sapien
actatatccatcacaacagacatgcttcatcccatagacttcttgacatagcttcaaatgagtgaacccatccttgatttatatacatatatgttctcagtattttgggagcctttccacttctttaaaccttgttcattatgaacactgaaaataggaatttgtgaagagttaaaaagttatagcttgtttacgtagtaagtttttgaagtctacattcaatccagacacttagttgagtgttaaactgtgatttttaaaaaatatcatttgagaatattctttcagaggtattttcatttttactttttgattaattgtgttttatatattagggtagt

SEQ ID NO: 42 - DNA, 101 bp, Homo sapien
acttactgaatttagttctgtgctcttccttatttagtgttgtatcataaatactttgatgtttcaaacattctaaataaataattttcagtggcttcata

SEQ ID NO: 43 - DNA, 305 bp, Homo sapien
acatctttgttacagtctaagatgtgttcttaaatcaccattccttcctggtcctcaccctccagggtggtctcacactgtaattagagctattgaggagtctttacagcaaattaagattcagatgccttgctaagtctagagttctagagttatgtttcagaaagtctaagaaacccacctcttgagaggtcagtaaagaggacttaatatttcatatctacaaaatgaccacaggattggatacagaacgagagttatcctggataactcagagctgagtacctgcccgggggccgctcgaa

SEQ ID NO: 44 - DNA, 852 bp, Homo sapien
  misc_feature (1)...(852): n = A,T,C or G
acataaatatcagagaaaagtagtctttgaaatatttacgtccaggagttctttgtttctgattatttggtgtgtgttttggtttgtgtccaaagtattggcagcttcagttttcattttctctccatcctcgggcattcttcccaaatttatataccagtcttcgtccatccacacgctccagaatttctcttttgtagtaatatctcatagctcggctgagcttttcataggtcatgctgctgttgttcttctttttaccccatagctgagccactgcctctgatttcaagaacctgaagacgccctcagatcggtcttcccattttattaatcctgggttcttgtctgggttcaagaggatgtcgcggatgaattcccataagtgagtccctctcgggttgtgctttttggtgtggcacttggcaggggggtcttgctcctttttcatatcaggtgactctgcaacaggaaggtgactggtggttgtcatggagatctgagcccggcagaaagttttgctgtccaacaaatctactgtgctaccatagttggtgtcatataaatagttctngtctttccaggtgttcatgatggaaggctcagtttgttcagtcttgacaatgacattgtgtgtggactggaacaggtcactactgcactggccgttccacttcagatgctgcaagttgctgtagaggagntgccccgccgtccctgccgcccgggtgaactcctgcaaactcatgctgcaaaggtgctcgccgttgatgtcgaactcntggaaagggatacaattggcatccagctggttggtgtccaggaggtgatggagccactcccacacctggt

SEQ ID NO: 45 - DNA, 234 bp, Homo sapien
acaacagacccttgctcgctaacgacctcatgctcatcaagttggacgaatccgtgtccgagtctgacaccatccggagcatcagcattgcttcgcagtgccctaccgcggggaactcttgcctcgtttctggctggggtctgctggcgaacggcagaatgcctaccgtgctgcagtgcgtgaacgtgtcggtggtgtctgaggaggtctgcagtaagctctatgacccgctgt

SEQ ID NO: 46 - DNA, 590 bp, Homo sapien
  misc_feature (1)...(590): n = A,T,C or G
actttttatttaaatgtttataaggcagatctatgagaatgatagaaaacatggtgtgtaatttgatagcaatattttggagattacagagttttagtaattaccaattacacagttaaaaagaagataatatattccaagcanatacaaaatatctaatgaaagatcaaggcaggaaaatgantataactaattgacaatggaaaatcaattttaatgtgaattgcacattatcctttaaaagctttcaaaanaaanaattattgcagtctanttaattcaaacagtgttaaatggtatcaggataaanaactgaagggcanaaagaattaattttcacttcatgtaacncacccanatttacaatggcttaaatgcanggaaaaagcagtggaagtagggaagtantcaaggtctttctggtctctaatctgccttactctttgggtgtggctttgatcctctggagacagctgccagggctcctgttatatccacaatcccagcagcaagatgaagggatgaaaaaggacacatgctgccttcctttgaggagacttcatctcactggccaacactcagtcacatgt

SEQ ID NO: 47 - DNA, 774 bp, Homo sapien
  misc_feature (1)...(774): n = A,T,C or G
acaagggggcataatgaaggagtgggganagattttaaagaaggaaaaaaaacgaggccctgaacagaattttcctgnacaacggggcttcaaaataattttcttggggaggttcaagacgcttcactgcttgaaacttaaatggatgtgggacanaattttctgtaatgaccctgagggcattacagacgggactctgggaggaaggataaacagaaaggggacaaaggctaatcccaaaacatcaaagaaaggaaggtggcgtcatacctcccagcctacacagttctccagggctctcctcatccctggaggacgacagtggaggaacaactgaccatgtccccaggctcctgtgtgctggctcctggtcttcagcccccagctctggaagcccaccctctgctgatcctgcgtggcccacactccttgaacacacatccccaggttatattcctggacatggctgaacctcctattcctacttccgagatgccttgctccctgcagcctgtcaaaatcccactcaccctccaaaccacggcatgggaagcctttctgacttgcctgattactccagcatcttggaacaatccctgattccccactccttagaggcaagatagggtggttaagagtagggctggaccacttggagccaggctgctggcttcaaattntggctcatttacgagctatgggaccttgggcaagtnatcttcacttctatgggcntcattttgttctacctgcaaaatgggggataataatagt

SEQ ID NO: 48 - DNA, 124 bp, Homo sapien
  misc_feature (1)...(124): n = A,T,C or G
canaaattgaaattttataaaaaggcatttttctcttatatccataaaatgatataatttttgcaantatanaaatgtgtcataaattataatgttccttaattacagctcaacgcaacttggt

SEQ ID NO: 49 - DNA, 147 bp, Homo sapien
  misc_feature (1)...(147): n = A,T,C or G
gccgatgctactattttattgcaggaggtgggggtgtttttattattctctcaacagctttgtggctacaggtggtgtctgactgcatnaaaaanttttttacgggtgattgcaaaaattttagggcacccatatcccaagcantgt

SEQ ID NO: 50 - DNA, 107 bp, Homo sapien
acattaaattaataaaaggactgttggggttctgctaaaacacatggcttgatatattgcatggtttgaggttaggaggagttaggcatatgttttgggagaggggt

SEQ ID NO: 51 - DNA, 204 bp, Homo sapien
gtcctaggaagtctaggggacacacgactctggggtcacggggccgacacacttgcacggcgggaaggaaaggcagagaagtgacaccgtcagggggaaatgacagaaaggaaaatcaaggccttgcaaggtcagaaaggggactcagggcttccaccacagccctgccccacttggccacctcccttttgggaccagcaatgt

SEQ ID NO: 52 - DNA, 491 bp, Homo sapien
  misc_feature (1)...(491): n = A,T,C or G
acaaagataacatttatcttataacaaaaatttgatagttttaaaggttagtattgtgtagggtattttccaaaagactaaagagataactcaggtaaaaagttagaaatgtataaaacaccatcagacaggtttttaaaaaacaacatattacaaaattagacaatcatccttaaaaaaaaaacttcttgtatcaatttcttttgttcaaaatgactgacttaantatttttaaatatttcanaaacacttcctcaaaaattttcaanatggtagctttcanatgtnccctcagtcccaatgttgctcagataaataaatctcgtgagaacttaccacccaccacaagctttctggggcatgcaacagtgtcttttctttnctttttctttttttttttttacaggcacagaaactcatcaattttatttggataacaaagggtctccaaattatattgaaaaataaatccaagttaatatcactcttgt

SEQ ID NO: 53 - DNA, 484 bp, Homo sapien
  misc_feature (1)...(484): n = A,T,C or G
acataatttagcagggctaattaccataagatgctatttattaanaggtntatgatctgagtattaacagttgctgaagtttggtatttttatgcagcattttctttttgctttgataacactacagaacccttaaggacactgaaaattagtaagtaaagttcagaaacattagctgctcaatcaaatctctacataacactatagtaattaaaacgttaaaaaaaagtgttgaaatctgcactagtatanaccgctcctgtcaggataanactgctttggaacagaaagggaaaaancagctttgantttctttgtgctgatangaggaaaggctgaattaccttgttgcctctccctaatgattggcaggtcnggtaaatnccaaaacatattccaactcaacacttcttttccncgtancttgantctgtgtattccaggancaggcggatggaatgggccagcccncggatgttccant

SEQ ID NO: 54 - DNA, 151 bp, Homo sapien
actaaacctcgtgcttgtgaactccatacagaaaacggtgccatccctgaacacggctggccactgggtatactgctgacaaccgcaacaacaaaaacacaaatccttggcactggctagtctatgtcctctcaagtgcctttttgtttgt

SEQ ID NO: 55 - DNA, 91 bp, Homo sapien
acctggcttgtctccgggtggttcccggcgccccccacggtccccagaacggacactttcgccctccagtggatactcgagccaaagtggt

SEQ ID NO: 56 - DNA, 133 bp, Homo sapien
ggcggatgtgcgttggttatatacaaatatgtcattttatgtaagggacttgagtatacttggatttttggtatctgtgggttggggggacggtccaggaaccaataccccatggataccaagggacaactgt

SEQ ID NO: 57 - DNA, 147 bp, Homo sapien
  misc_feature (1)...(147): n = A,T,C or G
actctggagaacctgagccgctgctccgcctctgggatgaggtgatgcangcngtggcgcgactgggagctgagcccttccctttgcgcctgcctcagaggattgttgccgacntgcanatctcantgggctggatncatgcagggt

SEQ ID NO: 58 - DNA, 198 bp, Homo sapien
  misc_feature (1)...(198): n = A,T,C or G
acagggatataggtttnaagttattgtnattgtaaaatacattgaattttctgtatactctgattacatacatttatcctttaaaaaagatgtaaatcttaatttttatgccatctattaatttaccaatgagttaccttgtaaatgagaagtcatgatagcactgaattttaactagttttgacttctaagtttggt

SEQ ID NO: 59 - DNA, 330 bp, Homo sapien
acaacaaatgggttgtgaggaagtcttatcagcaaaactggtgatggctactgaaaagatccattgaaaattatcattaatgattttaaatgacaagttatcaaaaactcactcaattttcacctgtgctagcttgctaaaatgggagttaactctagagcaaatatagtatcttctgaatacagtcaataaatgacaaagccagggcctacaggtggtttccagactttccagacccagcagaaggaatctattttatcacatggatctccgtctgtgctcaaaatacctaatgatatttttcgtctttattggacttctttgaagagt

SEQ ID NO: 60 - DNA, 175 bp, Homo sapien
accgtgggtgccttctacattcctgacggctccttcaccaacatctggttctacttcggcgtcgtgggctccttcctcttcatcctcatccagctggtgctgctcatcgactttgcgcactcctggaaccagcggtggctgggcaaggccgaggagtgcgattcccgtgcctggt

SEQ ID NO: 61 - DNA, 154 bp, Homo sapien
accccacttttcctcctgtgagcagtctggacttctcactgctacatgatgagggtgagtggttgttgctcttcaacagtatcctcccctttccggatctgctgagccggacagcagtgctggactgcacagccccggggctccacattgctgt

SEQ ID NO: 62 - DNA, 30 bp, Homo sapien
cgctcgagccctatagtgagtcgtattaga

SEQ ID NO: 63 - DNA, 89 bp, Homo sapien
acaagtcatttcagcaccctttgctcttcaaaactgaccatcttttatatttaatgcttcctgtatgaataaaaatggttatgtcaagt

SEQ ID NO: 64 - DNA, 97 bp, Homo sapien
accggagtaactgagtcgggacgctgaatctgaatccaccaataaataaaggttctgcagaatcagtgcatccaggattggtccttggatctggggt

SEQ ID NO: 65 - DNA, 377 bp, Homo sapien
  misc_feature (1)...(377): n = A,T,C or G
acaacaanaantcccttctttaggccactgatggaaacctggaacccccttttgatggcagcatggcgtcctaggccttgacacagcggctggggtttgggctntcccaaaccgcacaccccaaccctggtctacccacanttctggctatgggctgtctctgccactgaacatcagggttcggtcataanatgaaatcccaanggggacagaggtcagtagaggaagctcaatgagaaaggtgctgtttgctcagccagaaaacagctgcctggcattcgccgctgaactatgaacccgtgggggtgaactacccccangaggaatcatgcctgggcgatgcaanggtgccaacaggaggggcgggaggagcatgt

SEQ ID NO: 66 - DNA, 305 bp, Homo sapien
acgcctttccctcagaattcagggaagagactgtcgcctgccttcctccgttgttgcgtgagaacccgtgtgccccttcccaccatatccaccctcgctccatctttgaactcaaacacgaggaactaactgcaccctggtcctctccccagtccccagttcaccctccatccctcaccttcctccactctaagggatatcaacactgcccagcacaggggccctgaatttatgtggtttttatatattttttaataagatgcactttatgtcattttttaataaagtctgaagaattactgttt

SEQ ID NO: 67 - DNA, 385 bp, Homo sapien
actacacacactccacttgcccttgtgagacactttgtcccagcactttaggaatgctgaggtcggaccagccacatctcatgtgcaagattgcccagcagacatcaggtctgagagttccccttttaaaaaaggggacttgcttaaaaaagaagtctagccacgattgtgtagagcagctgtgctgtgctggagattcacttttgagagagttctcctctgagacctgatctttagaggctgggcagtcttgcacatgagatggggctggtctgatctcagcactccttagtctgcttgcctctcccagggccccagcctggccacacctgcttacagggcactctcagatgcccataccatagtttctgtgctagtggaccgt

SEQ ID NO: 68 - DNA, 73 bp, Homo sapien
acttaaccagatatatttttaccccagatggggatattctttgtaaaaaatgaaaataaagtttttttaatgg

SEQ ID NO: 69 - DNA, 536 bp, Homo sapien
  misc_feature (1)...(536): n = A,T,C or G
actagtccagtgtggtggaattccattgtgttgggggctctcaccctcctctcctgcagctccagctttgtgctctgcctctgaggagaccatggcccagcatctgagtaccctgctgctcctgctggccaccctagctgtggccctggcctggagccccaaggaggaggataggataatcccgggtggcatctataacgcagacctcaatgatgagtgggtacagcgtgcccttcacttcgccatcagcgagtataacaaggccaccaaagatgactactacagacgtccgctgcgggtactaagagccaggcaacagaccgttgggggggtgaattacttcttcgacgtagaggtgggccgaaccatatgtaccaagtcccagcccaacttggacacctgtgccttccatgaacagccagaactgcagaagaaacagttgtgctctttcgagatctacgaagttccctggggagaacagaangtccctgggtgaaatccaggtgtcaagaaatcctanggatctgttgccaggc

SEQ ID NO: 70 - DNA, 477 bp, Homo sapien
atgacccctaacaggggccctctcagccctcctaatgacctccggcctagccatgtgatttcacttccactccataacgctcctcatactaggcctactaaccaacacactaaccatataccaatgatggcgcgatgtaacacgagaaagcacataccaaggccaccacacaccacctgtccaaaaaggccttcgatacgggataatcctatttattacctcagaagtttttttcttcgcagggatttttctgagccttttaccactccagcctagcccctaccccccaactaggagggcactggcccccaacaggcatcaccccgctaaatcccctagaagtcccactcctaaacacatccgtattactcgcatcaggagtatcaatcacctgagctcaccatagtctaatagaaaacaaccgaaaccaaattattcaaagcactgcttattacaattttactgggtctctatttt

SEQ ID NO: 71 - DNA, 533 bp, Homo sapien
  misc_feature (1)...(533): n = A,T,C or G
agagctataggtacagtgtgatctcagctttgcaaacacattttctacatagatagtactaggtattaatagatatgtaaagaaagaaatcacaccattaataatggtaagattggtttatgtgattttagtggtatttttggcacccttatatatgttttccaaactttcagcagtgatattatttccataacttaaaaagtgagtttgaaaaagaaaatctccagcaagcatctcatttaaataaaggtttgtcatctttaaaaatacagcaatatgtgactttttaaaaaagctgtcaaataggtgtgaccctactaataattattagaaatacatttaaaaacatcgagtacctcaagtcagtttgccttgaaaaatatcaaatataactcttagagaaatgtacataaaagaatgcttcgtaattttggagtangaggttccctcctcaattttgtatttttaaaaagtacatggtaaaaaaaaaaattcacaacagtatataaggctgtaaaatgaagaattctgcc

SEQ ID NO: 72 - DNA, 511 bp, Homo sapien
  misc_feature (1)...(511): n = A,T,C or G
tattacggaaaaacacaccacataattcaactancaaagaanactgcttcagggcgtgtaaaatgaaaggcttccaggcagttatctgattaaagaacactaaaagagggacaaggctaaaagccgcaggatgtctacactatancaggcgctatttgggttggctggaggagctgtggaaaacatgganagattggtgctgganatcgccgtggctattcctcattgttattacanagtgaggttctctgtgtgcccactggtttgaaaaccgttctncaataatgatagaatagtacacacatgagaactgaaatggcccaaacccagaaagaaagcccaactagatcctcagaanacgcttctagggacaataaccgatgaagaaaagatggcctccttgtgcccccgtctgttatgatttctctccattgcagcnanaaacccgttcttctaagcaaacncaggtgatgatggcnaaaatacaccccctcttgaagnaccnggagga

SEQ ID NO: 73 - DNA, 499 bp, Homo sapien
  misc_feature (1)...(499): n = A,T,C or G
cagtgccagcactggtgccagtaccagtaccaataacagtgccagtgccagtgccagcaccagtggtggcttcagtgctggtgccagcctgaccgccactctcacatttgggctcttcgctggccttggtggagctggtgccagcaccagtggcagctctggtgcctgtggtttctcctacaagtgagattttagatattgttaatcctgccagtctttctcttcaagccagggtgcatcctcagaaacctactcaacacagcactctaggcagccactatcaatcaattgaagttgacactctgcattaaatctatttgccatttctgaaaaaaaaaaaaaaaaaagggcggccgctcgantctagagggcccgtttaaacccgctgatcagcctcgactgtgccttctanttgccagccatctgttgtttgcccctcccccgntgccttccttgaccctggaaagtgccactcccactgtcctttcctaantaaaat

SEQ ID NO: 74 - DNA, 537 bp, Homo sapien
  misc_feature (1)...(537): n = A,T,C or G
tttcataggagaacacactgaggagatacttgaagaatttggattcagccgcgaagagatttatcagcttaactcagataaaatcattgaaagtaataaggtaaaagctagtctctaacttccaggcccacggctcaagtgaatttgaatactgcatttacagtgtagagtaacacataacattgtatgcatggaaacatggaggaacagtattacagtgtcctaccactctaatcaagaaaagaattacagactctgattctacagtgatgattgaattctaaaaatggtaatcattagggcttttgatttataanactttgggtacttatactaaattatggtagttatactgccttccagtttgcttgatatatttgttgatattaagattcttgacttatattttgaatgggttctactgaaaaangaatgatatattcttgaagacatcgatatacatttatttacactcttgattctacaatgtagaaaatgaaggaaatgccccaaattgtatggtgataaaagtcccgt

SEQ ID NO: 75 - DNA, 467 bp, Homo sapien
  misc_feature (1)...(467): n = A,T,C or G
caaanacaattgttcaaaagatgcaaatgatacactactgctgcagctcacaaacacctctgcatattacacgtacctcctcctgctcctcaagtagtgtggtctattttgccatcatcacctgctgtctgcttagaagaacggctttctgctgcaanggagagaaatcataacagacggtggcacaaggaggccatcttttcctcatcggttattgtccctagaagcgtcttctgaggatctagttgggctttctttctgggtttgggccatttcanttctcatgtgtgtactattctatcattattgtataacggttttcaaaccngtgggcacncagagaacctcactctgtaataacaatgaggaatagccacggtgatctccagcaccaaatctctccatgttnttccagagctcctccagccaacccaaatagccgctgctatngtgtagaacatccctgn

SEQ ID NO: 76 - DNA, 400 bp, Homo sapien
  misc_feature (1)...(400): n = A,T,C or G
aagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatngttnagtgggatcganacatgtaagcagcancatgggaggt

SEQ ID NO: 77 - DNA, 248 bp, Homo sapien
ctggagtgccttggtgtttcaagcccctgcaggaagcagaatgcaccttctgaggcacctccagctgccccggcgggggatgcgaggctcggagcacccttgcccggctgtgattgctgccaggcactgttcatctcagcttttctgtccctttgctcccggcaagcgcttctgctgaaagttcatatctggagcctgatgtcttaacgaataaaggtcccatgctccacccgaaaaaaaaaaaaaaa

SEQ ID NO: 78 - DNA, 201 bp, Homo sapien
actagtccagtgtggtggaattccattgtgttgggcccaacacaatggctacctttaacatcacccagaccccgccctgcccgtgccccacgctgctgctaacgacagtatgatgcttactctgctactcggaaactatttttatgtaattaatgtatgctttcttgtttataaatgcctgatttaaaaaaaaaaaaaaaa

SEQ ID NO: 79 - DNA, 552 bp, Homo sapien
  misc_feature (1)...(552): n = A,T,C or G
tccttttgttaggtttttgagacaaccctagacctaaactgtgtcacagacttctgaatgtttaggcagtgctagtaatttcctcgtaatgattctgttattactttcctattctttattcctctttcttctgaagattaatgaagttgaaaattgaggtggataaatacaaaaaggtagtgtgatagtataagtatctaagtgcagatgaaagtgtgttatatatatccattcaaaattatgcaagttagtaattactcagggttaactaaattactttaatatgctgttgaacctactctgttccttggctagaaaaaattataaacaggactttgttagtttgggaagccaaattgataatattctatgttctaaaagttgggctatacataaantatnaagaaatatggaattttattcccaggaatatggggttcatttatgaatantacccggganagaagttttgantnaaaccngttttggttaatacgttaatatgtcctnaatnaacaaggcntgacttatttccaaaaaaaaaaaaaaaaa

SEQ ID NO: 80 - DNA, 476 bp, Homo sapien
  misc_feature (1)...(476): n = A,T,C or G
acagggatttgagatgctaaggccccagagatcgtttgatccaaccctcttattttcagaggggaaaatggggcctagaagttacagagcatctagctggtgcgctggcacccctggcctcacacagactcccgagtagctgggactacaggcacacagtcactgaagcaggccctgtttgcaattcacgttgccacctccaacttaaacattcttcatatgtgatgtccttagtcactaaggttaaactttcccacccagaaaaggcaacttagataaaatcttagagtactttcatactcttctaagtcctcttccagcctcactttgagtcctccttgggggttgataggaantntctcttggctttctcaataaaatctctatccatctcatgtttaatttggtacgcntaaaaatgctgaaaaaattaaaatgttctggtttcnctttaaaaaaaaaaaaaaaaaaaaaaa

SEQ ID NO: 81 - DNA, 232 bp, Homo sapien
  misc_feature (1)...(232): n = A,T,C or G
tttttttttgtatgccntcnctgtggngttattgttgctgccaccctggaggagcccagtttcttctgtatctttcttttctgggggatcttcctggctctgcccctccattcccagcctctcatccccatcttgcacttttgctagggttggaggcgctttcctggtagcccctcagagactcagtcagcgggaataagtcctaggggtggggggtgtggcaagccggcct

SEQ ID NO: 82 - DNA, 383 bp, Homo sapien
  misc_feature (1)...(383): n = A,T,C or G
aggcgggagcagaagctaaagccaaagcccaagaagagtggcagtgccagcactggtgccagtaccagtaccaataacatgccagtgccagtgccagcaccagtggtggcttcagtgctggtgccagcctgaccgccactctcacatttgggctcttcgctggccttggtggagctggtgccagcaccagtggcagctctggtgcctgtggtttctcctacaagtgagattttagatattgttaatcctgccagtctttctcttcaagccagggtgcatcctcagaaacctactcaacacagcactctnggcagccactatcaatcaattgaagttgacactctgcattaaatctatttgccatttcaaaaaaaaaaaaaaaa

SEQ ID NO: 83 - DNA, 494 bp, Homo sapien
  misc_feature (1)...(494): n = A,T,C or G
accgaattgggaccgctggcttataagcgatcatgtcctccagtattacctcaacgagcagggagatcgagtctatacgctgaagaaatttgacccgatgggacaacagacctgctcagcccatcctgctcggttctccccagatgacaaatactctcgacaccgaatcaccatcaagaaacgcttcaaggtgctcatgacccagcaaccgcgccctgtcctctgagggtccttaaactgatgtcttttctgccacctgttacccctcggagactccgtaaccaaactcttcggactgtgagccctgatgcctttttgccagccatactctttggcntccagtctctcgtggcgattgattatgcttgtgtgaggcaatcatggtggcatcacccatnaagggaacacatttganttttttttcncatattttaaattacnaccagaatanttcagaataaatgaattgaaaaactcttaaaaaaaaaaaaaaa

SEQ ID NO: 84 - DNA, 380 bp, Homo sapien
  misc_feature (1)...(380): n = A,T,C or G
gctggtagcctatggcgtggccacggangggctcctgaggcacgggacagtgacttcccaagtatcctgcgccgcgtcttctaccgtccctacctgcagatcttcgggcagattccccaggaggacatggacgtggccctcatggagcacagcaactgctcgtcggagcccggcttctgggcacaccctcctggggcccaggcgggcacctgcgtctcccagtatgccaactggctggtggtgctgctcctcgtcatcttcctgctcgtggccaacatcctgctggtcacttgctcattgccatgttcagttacacattcggcaaagtacagggcaacagcnatctctactgggaaggccagcgttnccgcctcatccgg

SEQ ID NO: 85 - DNA, 481 bp, Homo sapien
  misc_feature (1)...(481): n = A,T,C or G
gagttagctcctccacaaccttgatgaggtcgtctgcagtggcctctcgcttcataccgctnccatcgtcatactgtaggtttgccaccacctcctgcatcttggggcggctaatatccaggaaactctcaatcaagtcaccgtcnatnaaacctgtggctggttctgtcttccgctcggtgtgaaaggatctccagaaggagtgctcgatcttccccacacttttgatgactttattgagtcgattctgcatgtccagcaggaggttgtaccagctctctgacagtgaggtcaccagccctatcatgccnttgaacgtgccgaagaacaccgagccttgtgtggggggtgnagtctcacccagattctgcattaccaganagccgtggcaaaaganattgacaactcgcccaggnngaaaaagaacacctcctggaagtgctngccgctcctcgtccnttggtggnngcgcntncctttt

SEQ ID NO: 86 - DNA, 472 bp, Homo sapien
  misc_feature (1)...(472): n = A,T,C or G
aacatcttcctgtataatgctgtgtaatatcgatccgatnttgtctgctgagaattcattacttggaaaagcaacttnaagcctggacactggtattaaaattcacaatatgcaacactttaaacagtgtgtcaatctgctcccttactttgtcatcaccagtctgggaataagggtatgccctattcacacctgttaaaagggcgctaagcatttttgattcaacatctttttttttgacacaagtccgaaaaaagcaaaagtaaacagttnttaatttgttagccaattcactttcttcatgggacagagccatttgatttaaaaagcaaattgcataatattgagctttgggagctgatatntgagcggaagantagcctttctacttcaccagacacaactcctttcatattgggatgttnacnaaagttatgtctcttacagatgggatgcttttgtggcaattctg

SEQ ID NO: 87 - DNA, 413 bp, Homo sapien
  misc_feature (1)...(413): n = A,T,C or G
agaaaccagtatctctnaaaacaacctctcataccttgtggacctaattttgtgtgcgtgtgtgtgtgcgcgcatattatatagacaggcacatcttttttacttttgtaaaagcttatgcctctttggtatctatatctgtgaaagttttaatgatctgccataatgtcttggggacctttgtcttctgtgtaaatggtactagagaaaacacctatnttatgagtcaatctagttngttttattcgacatgaaggaaatttccagatnacaacactnacaaactctcccttgactaggggggacaaagaaaagcanaactgaacatnagaaacaattncctggtgagaaattncataaacagaaattgggtngtatattgaaananngcatcattnaaacgtttttttttt

SEQ ID NO: 88 - DNA, 448 bp, Homo sapien
  misc_feature (1)...(448): n = A,T,C or G
cgcagcgggtcctctctatctagctccagcctctcgcctgccccactccccgcgtcccgcgtcctagccnaccatggccgggcccctgcgcgccccgctgctcctgctggccatcctggccgtggccctggccgtgagccccgcggccggctccagtcccggcaagccgccgcgcctggtgggaggcccatggaccccgcgtggaagaagaaggtgtgcggcgtgcactggactttgccgtcggcnantacaacaaacccgcaacnacttttaccnagcncgcgctgcaggttgtgccgccccaancaaattgttactnggggtaantaattcttggaagttgaacctgggccaaacnngtttaccagaaccnagccaattngaacaattncccctccataacagccccttttaaaaagggaancantcctgntcttttccaaatttt

SEQ ID NO: 89 - DNA, 463 bp, Homo sapien
  misc_feature (1)...(463): n = A,T,C or G
gaattttgtgcactggccactgtgatggaaccattgggccaggatgctttgagtttatcagtagtgattctgccaaagttggtgttgtaacatgagtatgtaaaatgtcaaaaaattagcagaggtctaggtctgcatatcagcagacagtttgtccgtgtattttgtagccttgaagttctcagtgacaagttnnttctgatgcgaagttctnattccagtgttttagtcctttgcatctttnatgttnagacttgcctctntnaaattgcttttgtnttctgcaggtactatctgtggtttaacaaaatagaannacttctctgcttngaanatttgaatatcttacatctnaaaatnaattctctccccatannaaaacccangcccttggganaatttgaaaaanggntccttcnnaattcnnanaanttcagntntcatacaacanaacnggancccc

SEQ ID NO: 90 - DNA, 400 bp, Homo sapien
  misc_feature (1)...(400): n = A,T,C or G
agggattgaaggtctnttntactgtcggactgttcanccaccaactctacaagttgctgtcttccactcactgtctgtaagcntnttaacccagactgtatcttcataaatagaacaaattcttcaccagtcacatcttctaggacctttttggattcagttagtataagctcttccacttcctttgttaagacttcatctggtaaagtcttaagttttgtagaaaggaatttaattgctcgttctctaacaatgtcctctccttgaagtatttggctgaacaacccacctnaagtccctttgtgcatccattttaaatatacttaatagggcattggtncactaggttaaattctgcaagagtcatctgtctgcaaaagttgcgttagtatatctgcca

SEQ ID NO: 91 - DNA, 480 bp, Homo sapien
  misc_feature (1)...(480): n = A,T,C or G
gagctcggatccaataatctttgtctgagggcagcacacatatncagtgccatggnaactggtctaccccacatgggagcagcatgccgtagntatataaggtcattccctgagtcagacatgcctctttgactaccgtgtgccagtgctggtgattctcacacacctccnnccgctctttgtggaaaaactggcacttgnctggaactagcaagacatcacttacaaattcacccacgagacacttgaaaggtgtaacaaagcgactcttgcattgctttttgtccctccggcaccagttgtcaatactaacccgctggtttgcctccatcacatttgtgatctgtagctctggatacatctcctgacagtactgaagaacttcttcttttgtttcaaaagcaactcttggtgcctgttngatcaggttcccatttcccagtccgaatgttcacatggcatatnttacttcccacaaaa

SEQ ID NO: 92 - DNA, 477 bp, Homo sapien
  misc_feature (1)...(477): n = A,T,C or G
atacagcccanatcccaccacgaagatgcgcttgttgactgagaacctgatgcggtcactggtcccgctgtagccccagcgactctccacctgctggaagcggttgatgctgcactccttcccacgcaggcagcagcggggccggtcaatgaactccactcgtggcttggggttgacggttaantgcaggaagaggctgaccacctcgcggtccaccaggatgcccgactgtgcgggacctgcagcgaaactcctcgatggtcatgagcgggaagcgaatgangcccagggccttgcccagaaccttccgcctgttctctggcgtcacctgcagctgctgccgctnacactcggcctcggaccagcggacaaacggcgttgaacagccgcacctcacggatgcccantgtgtcgcgctccaggaacggcnccagcgtgtccaggtcaatgtcggtgaancctccgcgggtaatggcg

SEQ ID NO: 93 - DNA, 377 bp, Homo sapien
  misc_feature (1)...(377): n = A,T,C or G
gaacggctggaccttgcctcgcattgtgctgctggcaggaataccttggcaagcagctccagtccgagcagccccagaccgctgccgcccgaagctaagcctgcctctggccttcccctccgcctcaatgcagaaccantagtgggagcactgtgtttagagttaagagtgaacactgtntgattttacttgggaatttcctctgttatatagcttttcccaatgctaatttccaaacaacaacaacaaaataacatgtttgcctgttnagttgtataaaagtangtgattctgtatntaaagaaaatattactgttacatatactgcttgcaanttctgtatttattggtnctctggaaataaatatattattaaa

SEQ ID NO: 94 - DNA, 495 bp, Homo sapien
  misc_feature (1)...(495): n = A,T,C or G
ccctttgaggggttagggtccagttcccagtggaagaaacaggccaggagaantgcgtgccgagctgangcagatttcccacagtgaccccagagccctgggctatagtctctgacccctccaaggaaagaccaccttctggggacatgggctggagggcaggacctagaggcaccaagggaaggccccattccggggctgttccccgaggaggaagggaaggggctctgtgtgccccccacgaggaanaggccctgantcctgggatcanacaccccttcacgtgtatccccacacaaatgcaagctcaccaaggtcccctctcagtcccttccctacaccctgaacggncactggcccacacccacccagancanccacccgccatggggaatgtnctcaaggaatcgcngggcaacgtggactctngtcccnnaagggggcagaatctccaatagangganngaacccttgctnanaaaaaaaaanaaaaaa

SEQ ID NO: 95 - DNA, 472 bp, Homo sapien
  misc_feature (1)...(472): n = A,T,C or G
ggttacttggtttcattgccaccacttagtggatgtcatttagaaccattttgtctgctccctctggaagccttgcgcagagcggactttgtaattgttggagaataactgctgaatttttagctgttttgagttgattcgcaccactgcaccacaactcaatatgaaaactatttnacttatttattatcttgtgaaaagtatacaatgaaaattttgttcatactgtatttatcaagtatgatgaaaagcaatagatatatattcttttattatgttnaattatgattgccattattaatcggcaaaatgtggagtgtatgttcttttcacagtaatatatgccttttgtaacttcacttggttattttattgtaaatgaattacaaaattcttaatttaagaaaatggtangttatatttanttcantaatttctttccttgtttacgttaattttgaaaagaatgcat

SEQ ID NO: 96 - DNA, 476 bp, Homo sapien
  misc_feature (1)...(476): n = A,T,C or G
ctgaagcatttcttcaaacttntctacttttgtcattgatacctgtagtaagttgacaatgtggtgaaatttcaaaattatatgtaacttctactagttttactttctcccccaagtcttttttaactcatgatttttacacacacaatccagaacttattatatagcctctaagtctttattcttcacagtagatgatgaaagagtcctccagtgtcttgngcanaatgttctagntatagctggatacatacngtgggagttctataaactcatacctcagtgggactnaaccaaaattgtgttagtctcaattcctaccacactgagggagcctcccaaatcactatattcttatctgcaggtactcctccagaaaaacngacagggcaggcttgcatgaaaaagtnacatctgcgttacaaagtctatcttcctcanangtctgtnaaggaacaatttaatcttctagcttt

SEQ ID NO: 97 - DNA, 479 bp, Homo sapien
  misc_feature (1)...(479): n = A,T,C or G
actctttctaatgctgatatgatcttgagtataagaatgcatatgtcactagaatggataaaataatgctgcaaacttaatgttcttatgcaaaatggaacgctaatgaaacacagcttacaatcgcaaatcaaaactcacaagtgctcatctgttgtagatttagtgtaataagacttagattgtgctccttcggatatgattgtttctcanatcttgggcaatnttccttagtcaaatcaggctactagaattctgttattggatatntgagagcatgaaatttttaanaatacacttgtgattatnaaattaatcacaaatttcacttatacctgctatcagcagctagaaaaacatntnntttttanatcaaagtattttgtgtttggaantgtnnaaatgaaatctgaatgtgggttcnatcttattttttcccngacnactanttncttttttagggnctattctganccatc

SEQ ID NO: 98 - DNA, 461 bp, Homo sapien
agtgacttgtcctccaacaaaaccccttgatcaagtttgtggcactgacaatcagacctatgctagttcctgtcatctattcgctactaaatgcagactggaggggaccaaaaaggggcatcaactccagctggattattttggagcctgcaaatctattcctacttgtacggactttgaagtgattcagtttcctctacggatgagagactggctcaagaatatcctcatgcagctttatgaagccactctgaacacgctggttatctagatgagaacagagaaataaagtcagaaaatttacctggagaaaagaggctttggctggggaccatcccattgaaccttctcttaaggactttaagaaaaactaccacatgttgtgtatcctggtgccggccgtttatgaactgaccaccctttggaataatcttgacgctcctgaacttgctcctctgcga

SEQ ID NO: 99 - DNA, 171 bp, Homo sapien
gtggccgcgcgcaggtgtttcctcgtaccgcagggccccctcccttccccaggcgtccctcggcgcctctgcgggcccgaggaggagcggctggcgggtggggggagtgtgacccaccctcggtgagaaaagccttctctagcgatctgagaggcgtgccttgggggtacc

SEQ ID NO: 100 - DNA, 269 bp, Homo sapien
cggccgcaagtgcaactccagctggggccgtgcggacgaagattctgccagcagttggtccgactgcgacgacggcggcggcgacagtcgcaggtgcagcgcgggcgcctggggtcttgcaaggctgagctgacgccgcagaggtcgtgtcacgtcccacgaccttgacgccgtcggggacagccggaacagagcccggtgaagcgggaggcctcggggagcccctcgggaagggcggcccgagagatacgcaggtgcaggtggccgcc

SEQ ID NO: 101 - DNA, 405 bp, Homo sapien
ttttttttttttttggaatctactgcgagcacagcaggtcagcaacaagtttattttgcagctagcaaggtaacagggtagggcatggttacatgttcaggtcaacttcctttgtcgtggttgattggtttgtctttatgggggcggggtggggtaggggaaacgaagcaaataacatggagtgggtgcaccctccctgtagaacctggttacaaagcttggggcagttcacctggtctgtgaccgtcattttcttgacatcaatgttattagaagtcaggatatcttttagagagtccactgttctggagggagattagggtttcttgccaaatccaacaaaatccactgaaaaagttggatgatcagtacgaataccgaggcatattctcatatcggtggcca

SEQ ID NO: 102 - DNA, 470 bp, Homo sapien
ttttttttttttttttttttttttttttttttttttttttttttttttttttttttttttggcacttaatccatttttatttcaaaatgtctacaaatttaatcccattatacggtattttcaaaatctaaattattcaaattagccaaatccttaccaaataatacccaaaaatcaaaaatatacttctttcagcaaacttgttacataaattaaaaaaatatatacggctggtgttttcaaagtacaattatcttaacactgcaaacattttaaggaactaaaataaaaaaaaacactccgcaaaggttaaagggaacaacaaattcttttacaacaccattataaaaatcatatctcaaatcttaggggaatatatacttcacacgggatcttaacttttactcactttgtttatttttttaaaccattgtttgggcccaacacaatggaatcccccctggactagt

SEQ ID NO: 103 - DNA, 581 bp, Homo sapien
ttttttttttttttttttgacccccctcttataaaaaacaagttaccattttattttacttacacatatttattttataattggtattagatattcaaaaggcagcttttaaaatcaaactaaatggaaactgccttagatacataattcttaggaattagcttaaaatctgcctaaagtgaaaatcttctctagctcttttgactgtaaatttttgactcttgtaaaacatccaaattcatttttcttgtctttaaaattatctaatctttccattttttccctattccaagtcaatttgcttctctagcctcatttcctagctcttatctactattagtaagtggcttttttcctaaaagggaaaacaggaagagaaatggcacacaaaacaaacattttatattcatatttctacctacgttaataaaatagcattttgtgaagccagctcaaaagaaggcttagatccttttatgtccattttagtcactaaacgatatcaaagtgccagaatgcaaaaggtttgtgaacatttattcaaaagctaatataagatatttcacatactcatctttctg

SEQ ID NO: 104 - DNA, 578 bp, Homo sapien
tttttttttttttttttttttttttctcttctttttttttgaaatgaggatcgagtttttcactctctagatagggcatgaagaaaactcatctttccagctttaaaataacaatcaaatctcttatgctatatcatattttaagttaaactaatgagtcactggcttatcttctcctgaaggaaatctgttcattcttctcattcatatagttatatcaagtactaccttgcatattgagaggtttttcttctctatttacacatatatttccatgtgaatttgtatcaaacctttattttcatgcaaactagaaaataatgtttcttttgcataagagaagagaacaatatagcattacaaaactgctcaaattgtttgttaagttatccattataattagttggcaggagctaatacaaatcacatttacgacagcaataataaaactgaagtaccagttaaatatccaaaataattaaaggaacatttttagcctgggtataattagctaattcactttacaagcatttattagaatgaattcacatgttattattcctagcccaacacaatgg

SEQ ID NO: 105 - DNA, 538 bp, Homo sapien
tttttttttttttttcagtaataatcagaacaatatttatttttatatttaaaattcatagaaaagtgccttacatttaataaaagtttgtttctcaaagtgatcagaggaattagatatgtcttgaacaccaatattaatttgaggaaaatacaccaaaatacattaagtaaattatttaagatcatagagcttgtaagtgaaaagataaaatttgacctcagaaactctgagcattaaaaatccactattagcaaataaattactatggacttcttgctttaattttgtgatgaatatggggtgtcactggtaaaccaacacattctgaaggatacattacttagtgatagattcttatgtactttgctaatacgtggatatgagttgacaagtttctctttcttcaatcttttaaggggcgagaaatgaggaagaaaagaaaaggattacgcatactgttctttctatggaaggattagatatgtttcctttgccaatattaaaaaaataataatgtttactactagtgaaaccc

SEQ ID NO: 106 - DNA, 473 bp, Homo sapien
ttttttttttttttttagtcaagtttctatttttattataattaaagtcttggtcatttcatttattagctctgcaacttacatatttaaattaaagaaacgttttagacaactgtacaatttataaatgtaaggtgccattattgagtaatatattcctccaagagtggatgtgtcccttctcccaccaactaatgaacagcaacattagtttaattttattagtagatatacactgctgcaaacgctaattctcttctccatccccatgtgatattgtgtatatgtgtgagttggtagaatgcatcacaatctacaatcaacagcaagatgaagctaggctgggctttcggtgaaaatagactgtgtctgtctgaatcaaatgatctgacctatcctcggtggcaagaactcttcgaaccgcttcctcaaaggcgctgccacatttgtggctctttgcacttgtttcaaaa

SEQ ID NO: 107 - DNA, 1621 bp, Homo sapien
cgccatggcactgcagggcatctcggtcatggagctgtccggcctggccccgggcccgttctgtgctatggtcctggctgacttcggggcgcgtgtggtacgcgtggaccggcccggctcccgctacgacgtgagccgcttgggccggggcaagcgctcgctagtgctggacctgaagcagccgcggggagccgccgtgctgcggcgtctgtgcaagcggtcggatgtgctgctggagcccttccgccgcggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactgacaagggtcaggtcattgatgcaaatatggtggaaggaacagcatatttaagttcttttctgtggaaaactcagaaatcgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcaaagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaacttccaggcccacggctcaagtgaatttgaatactgcatttacagtgtagagtaacacataacattgtatgcatggaaacatggaggaacagtattacagtgtcctaccactctaatcaagaaaagaattacagactctgattctacagtgatgattgaattctaaaaatggttatcattagggcttttgatttataaaactttgggtacttatactaaattatggtagttattctgccttccagtttgcttgatatatttgttgatattaagattcttgacttatattttgaatgggttctagtgaaaaaggaatgatatattcttgaagacatcgatatacatttatttacactcttgattctacaatgtagaaaatgaggaaatgccacaaattgtatggtgataaaagtcacgtgaaacaaaaaaaaaaaaaaaaaaaaaaaaaaaaaaaaaaaaaaaaaaaaa

SEQ ID NO: 108 - protein, 382 aa, Homo sapien [sequence omitted]

SEQ ID NO: 109 - DNA, 1524 bp, Homo sapien
ggcacgaggctgcgccagggcctgagcggaggcgggggcagcctcgccagcgggggccccgggcctggccatgcctcactgagccagcgcctgcgcctctacctcgccgacagctggaaccagtgcgacctagtggctctcacctgcttcctcctgggcgtgggctgccggctgaccccgggtttgtaccacctgggccgcactgtcctctgcatcgacttcatggttttcacggtgcggctgcttcacatcttcacggtcaacaaacagctggggcccaagatcgtcatcgtgagcaagatgatgaaggacgtgttcttcttcctcttcttcctcggcgtgtggctggtagcctatggcgtggccacggaggggctcctgaggccacgggacagtgacttcccaagtatcctgcgccgcgtcttctaccgtccctacctgcagatcttcgggcagattccccaggaggacatggacgtggccctcatggagcacagcaactgctcgtcggagcccggcttctgggcacaccctcctggggcccaggcgggcacctgcgtctcccagtatgccaactggctggtggtgctgctcctcgtcatcttcctgctcgtggccaacatcctgctggtcaacttgctcattgccatgttcagttacacattcggcaaagtacagggcaacagcgatctctactggaaggcgcagcgttaccgcctcatccgggaattccactctcggcccgcgctggccccgccctttatcgtcatctcccacttgcgcctcctgctcaggcaattgtgcaggcgaccccggagcccccagccgtcctccccggccctcgagcatttccgggtttacctttctaaggaagccgagcggaagctgctaacgtgggaatcggtgcataaggagaactttctgctggcacgcgctagggacaagcgggagagcgactccgagcgtctgaagcgcacgtcccagaaggtggacttggcactgaaacagctgggacacatccgcgagtacgaacagcgcctgaaagtgctggagcgggaggtccagcagtgtagccgcgtcctggggtgggtggccgaggccctgagccgctctgccttgctgcccccaggtgggccgccaccccctgacctgcctgggtccaaagactgagccctgctggcggacttcaaggagaagcccccacaggggattttgctcctagagtaaggctcatctgggcctcggcccccgcacctggtggccttgtccttgaggtgagccccatgtccatctgggccactgtcaggaccacctttgggagtgtcatccttacaaaccacagcatgcccggctcctcccagaaccagtcccagcctgggaggatcaaggcctggatcccgggccgttatccatctggaggctgcagggtccttggggtaacagggaccacagacccctcaccactcacagattcctcacactggggaaataaagccatttcagaggaaaaaaaaaaaaaaaaaa

SEQ ID NO: 110 - DNA, 3410 bp, Homo sapien
gggaaccagcctgcacgcgctggctccgggtgacagccgcgcgcctcggccaggatctgagtgatgagacgtgtccccactgaggtgccccacagcagcaggtgttgagcatgggctgagaagctggaccggcaccaaagggctggcagaaatgggcgcctggctgattcctaggcagttggcggcagcaaggaggagaggccgcagcttctggagcagagccgagacgaagcagttctggagtgcctgaacggccccctgagccctacccgcctggcccactatggtccagaggctgtgggtgagccgcctgctgcggcaccggaaagcccagctcttgctggtcaacctgctaacctttggcctggaggtgtgtttggccgcaggcatcacctatgtgccgcctctgctgctggaagtgggggtagaggagaagttcatgaccatggtgctgggcattggtccagtgctgggcctggtctgtgtcccgctcctaggctcagccagtgaccactggcgtggacgctatggccgccgccggcccttcatctgggcactgtccttgggcatcctgctgagcctctttctcatcccaagggccggctggctagcagggctgctgtgcccggatcccaggcccctggagctggcactgctcatcctgggcgtggggctgctggacttctgtggccaggtgtgcttcactccactggaggccctgctctctgacctcttccgggacccggaccactgtcgccaggcctactctgtctatgccttcatgatcagtcttgggggctgcctgggctacctcctgcctgccattgactgggacaccagtgccctggccccctacctgggcacccaggaggagtgcctctttggcctgctcaccctcatcttcctcacctgcgtagcagccacactgctggtggctgaggaggcagcgctgggccccaccgagccagcagaagggctgtcggccccctccttgtcgccccactgctgtccatgccgggcccgcttggctttccggaacctgggcgccctgcttccccggctgcaccagctgtgctgccgcatgccccgcaccctgcgccggctcttcgtggctgagctgtgcagctggatggcactcatgaccttcacgctgttttacacggatttcgtgggcgaggggctgtaccagggcgtgcccagagctgagccgggcaccgaggcccggagacactatgatgaaggcgttcggatgggcagcctggggctgttcctgcagtgcgccatctccctggtcttctctctggtcatggaccggctggtgcagcgattcggcactcgagcagtctatttggccagtgtggcagctttccctgtggctgccggtgccacatgcctgtcccacagtgtggccgtggtgacagcttcagccgccctcaccgggttcaccttctcagccctgcagatcctgccctacacactggcctccctctaccaccgggagaagcaggtgttcctgcccaaataccgaggggacactggaggtgctagcagtgaggacagcctgatgaccagcttcctgccaggccctaagcctggagctcccttccctaatggacacgtgggtgctggaggcagtggcctgctcccacctccacccgcgctctgcggggcctctgcctgtgatgtctccgtacgtgtggtggtgggtgagcccaccgaggccagggtggttccgggccggggcatctgcctggacctcgccatcctggatagtgccttcctgctgtcccaggtggccccatccctgtttatgggctccattgtccagctcagccagtctgtcactgcctatatggtgtctgccgcaggcctgggtctggtcgccatttactttgctacacaggtagtatttgacaagagcgacttggccaaatactcagcgtagaaaacttccagcacattggggtggagggcctgcctcactgggtcccagctccccgctcctgttagccccatggggctgccgggctggccgccagtttctgttgctgccaaagtaatgtggctctctgctgccaccctgtgctgctgaggtgcgtagctgcacagctgggggctggggcgtccctctcctctctccccagtctctagggctgcctgactggaggccttccaagggggtttcagtctggacttatacagggaggccagaagggctccatgcactggaatgcggggactctgcaggtggattacccaggctcagggttaacagctagcctcctagttgagacacacctagagaagggtttttgggagctgaataaactcagtcacctggtttcccatctctaagccccttaacctgcagcttcgtttaatgtagctcttgcatgggagtttctaggatgaaacactcctccatgggatttgaacatatgacttatttgtaggggaagagtcctgaggggcaacacacaagaaccaggtcccctcagcccacagcactgtctttttgctgatccacccccctcttaccttttatcaggatgtggcctgttggtccttctgttgccatcacagagacacaggcatttaaatatttaacttatttatttaacaaagtagaagggaatccattgctagcttttctgtgttggtgtctaatatttgggtagggtgggggatccccaacaatcaggtcccctgagatagctggtcattgggctgatcattgccagaatcttcttctcctggggtctggccccccaaaatgcctaacccaggaccttggaaattctactcatcccaaatgataattccaaatgctgttacccaaggttagggtgttgaaggaaggtagagggtggggcttcaggtctcaacggcttccctaaccacccctcttctcttggcccagcctggttccccccacttccactcccctctactctctctaggactgggctgatgaaggcactgcccaaaatttcccctacccccaactttcccctacccccaactttccccaccagctccacaaccctgtttggagctactgcaggaccagaagcacaaagtgcggtttcccaagcctttgtccatctcagcccccagagtatatctgtgcttggggaatctcacacagaaactcaggagcaccccctgcctgagctaagggaggtcttatctctcagggggggtttaagtgccgtttgcaataatgtcgtcttatttatttagcggggtgaatattttatactgtaagtgagcaatcagagtataatgtttatggtgacaaaattaaaggctttcttatatgtttaaaaaaaaaaaaaaaaaaaaaaaaaaaaaaaaaaaaaaaaaaaraaaaaaaaaaaaaaaaaaaaaaaaaaaataaaaaaaaaaaa

SEQ ID NO: 111 - DNA, 1289 bp, Homo sapien
agccaggcgtccctctgcctgcccactcagtggcaacacccgggagctgttttgtcctttgtggagcctcagcagttccctctttcagaactcactgccaagagccctgaacaggagccaccatgcagtgcttcagcttcattaagaccatgatgatcctcttcaatttgctcatctttctgtgtggtgcagccctgttggcagtgggcatctgggtgtcaatcgatggggcatcctttctgaagatcttcgggccactgtcgtccagtgccatgcagtttgtcaacgtgggctacttcctcatcgcagccggcgttgtggtctttgctcttggtttcctgggctgctatggtgctaagactgagagcaagtgtgccctcgtgacgttcttcttcatcctcctcctcatcttcattgctgaggttgcagctgctgtggtcgccttggtgtacaccacaatggctgagcacttcctgacgttgctggtagtgcctgccatcaagaaagattatggttcccaggaagacttcactcaagtgtggaacaccaccatgaaagggctcaagtgctgtggcttcaccaactatacggattttgaggactcaccctacttcaaagagaacagtgcctttcccccattctgttgcaatgacaacgtcaccaacacagccaatgaaacctgcaccaagcaaaaggctcacgaccaaaaagtagagggttgcttcaatcagcttttgtatgacatccgaactaatgcagtcaccgtgggtggtgtggcagctggaattgggggcctcgagctggctgccatgattgtgtccatgtatctgtactgcaatctacaataagtccacttctgcctctgccactactgctgccacatgggaactgtgaagaggcaccctggcaagcagcagtgattgggggaggggacaggatctaacaatgtcacttgggccagaatggacctgccctttctgctccagacttggggctagatagggaccactccttttagcgatgcctgactttccttccattggtgggtggatgggtggggggcattccagagcctctaaggtagccagttctgttgcccattcccccagtctattaaacccttgatatgccccctaggcctagtggtgatcccagtgctctactgggggatgagagaaaggcattttatagcctgggcataagtgaaatcagcagagcctctgggtggatgtgtagaaggcacttcaaaatgcataaacctgttacaatgttaaaaaaaaaaaaaaaaa

SEQ ID NO: 112 - protein, 315 aa, Homo sapien
MVFTVRLLHIFTVNKQLGPKIVIVSKMMKDVFFFLFFLGVWLVAYGVATEGLLRPRDSDFPSILRRVFYRPYLQIFGQIPQEDMDVALMEHSNCSSEPGFWAHPPGAQAGTCVSQYANWLVVLLLVIFLLVANILLVNLLIAMFSYTFGKVQGNSDLYWKAQRYRLIREFHSRPALAPPFIVISHLRLLLRQLCRRPRSPQPSSPALEHFRVYLSKEAERKLLTWESVHKENFLLARARDKRESDSERLKRTSQKVDLALKQLGHIREYEQRLKVLEREVQQCSRVLGWVAEALSRSALLPPGGPPPPDLPGSKD

SEQ ID NO: 113 - protein, 553 aa, Homo sapien
MVQRLWVSRLLRHRKAQLLLVNLLTFGLEVCLAAGITYVPPLLLEVGVEEKFMTMVLGIGPVLGLVCVPLLGSASDHWRGRYGRRRPFIWALSLGILLSLFLIPRAGWLAGLLCPDPRPLELALLILGVGLLDFCGQVCFTPLEALLSDLFRDPDHCRQAYSVYAFMISLGGCLGYLLPAIDWDTSALAPYLGTQEECLFGLLTLIFLTCVAATLLVAEEAALGPTEPAEGLSAPSLSPHCCPCRARLAFRNLGALLPRLHQLCCRMPRTLRRLFVAELCSWMALMTFTLFYTDFVGEGLYQGVPRAEPGTEARRHYDEGVRMGSLGLFLQCAISLVFSLVMDRLVQRFGTRAVYLASVAAFPVAAGATCLSHSVAVVTASAALTGFTFSALQILPYTLASLYHREKQVFLPKYRGDTGGASSEDSLMTSFLPGPKPGAPFPNGHVGAGGSGLLPPPPALCGASACDVSVRVVVGEPTEARVVPGRGICLDLAILDSAFLLSQVAPSLFMGSIVQLSQSVTAYMVSAAGLGLVAIYFATQVVFDKSDLAKYSA

SEQ ID NO: 114 - protein, 241 aa, Homo sapien
MQCFSFIKTMMILFNLLIFLCGAALLAVGIWVSIDGASFLKIFGPLSSSAMQFVNVGYFLIAAGVVVFALGFLGCYGAKTESKCALVTFFFILLLIFIAEVAAAVVALVYTTMAEHFLTLLVVPAIKKDYGSQEDFTQVWNTTMKGLKCCGFTNYTDFEDSPYFKENSAFPPFCCNDNVTNTANETCTKQKAHDQKVEGCFNQLLYDIRTNAVTVGGVAAGIGGLELAAMIVSMYLYCNLQ

SEQ ID NO: 115 - DNA, 366 bp, Homo sapien
gctctttctctcccctcctctgaatttaattctttcaacttgcaatttgcaaggattacacatttcactgtgatgtatattgtgttgcaaaaaaaaaaaagtgtctttgtttaaaattacttggtttgtgaatccatcttgctttttccccattggaactagtcattaacccatctctgaactggtagaaaaacatctgaagagctagtctatcagcatctgacaggtgaattggatggttctcagaaccatttcacccagacagcctgtttctatcctgtttaataaattagtttgggttctctacatgcataacaaaccctgctccaatctgtcacataaaagtctgtgacttgaagtttagtc

SEQ ID NO: 116 - DNA, 282 bp, Homo sapien
  misc_feature (1)...(282): n = A,T,C or G
acaaagatgaaccatttcctatattatagcaaaattaaaatctacccgtattctaatattgagaaatgagatnaaacacaatnttataaagtctacttagagaagatcaagtgacctcaaagactttactattttcatattttaagacacatgatttatcctattttagtaacctggttcatacgttaaacaaaggataatgtgaacagcagagaggatttgttggcagaaaatctatgttcaatctngaactatctanatcacagacatttctattccttt

SEQ ID NO: 117 - DNA, 305 bp, Homo sapien
  misc_feature (1)...(305): n = A,T,C or G
acacatgtcgcttcactgccttcttagatgcttctggtcaacatanaggaacagggaccatatttatcctccctcctgaaacaattgcaaaataanacaaaatatatgaaacaattgcaaaataaggcaaaatatatgaaacaacaggtctcgagatattggaaatcagtcaatgaaggatactgatccctgatcactgtcctaatgcaggatgtgggaaacagatgaggtcacctctgtgactgccccagcttactgcctgtagagagtttctangctgcagttcagacagggagaaattgggt

SEQ ID NO: 118 - DNA, 71 bp, Homo sapien
  misc_feature (1)...(71): n = A,T,C or G
accaaggtgtntgaatctctgacgtggggatctctgattcccgcacaatctgagtggaaaaantcctgggt

SEQ ID NO: 119 - DNA, 212 bp, Homo sapien
  misc_feature (1)...(212): n = A,T,C or G
actccggttggtgtcagcagcacgtggcattgaacatngcaatgtggagcccaaaccacagaaaatggggtgaaattggccaactttctatnaacttatgttggcaantttgccaccaacagtaagctggcccttctaataaaagaaaattgaaaggtttctcactaancggaattaantaatggantcaaganactcccaggcctcagcgt

SEQ ID NO: 120 - DNA, 90 bp, Homo sapien
  misc_feature (1)...(90): n = A,T,C or G
actcgttgcanatcaggggccccccagagtcaccgttgcaggagtccttctggtcttgccctccgccggcgcagaacatgctggggtggt

SEQ ID NO: 121 - DNA, 218 bp, Homo sapien
  misc_feature (1)...(218): n = A,T,C or G
tgtancgtgaanacgacaganagggttgtcaaaaatggagaanccttgaagtcattttgagaataagatttgctaaaagatttggggctaaaacatggttattgggagacatttctgaagatatncangtaaattanggaatgaattcatggttcttttgggaattcctttacgatngccagcatanacttcatgtggggatancagctacccttgta

SEQ ID NO: 122 - DNA, 171 bp, Homo sapien
taggggtgtatgcaactgtaaggacaaaaattgagactcaactggcttaaccaataaaggcatttgttagctcatggaacaggaagtcggatggtggggcatcttcagtgctgcatgagtcaccaccccggcggggtcatctgtgccacaggtccctgttgacagtgcggt

SEQ ID NO: 123 - DNA, 76 bp, Homo sapien
  misc_feature (1)...(76): n = A,T,C or G
tgtagcgtgaagacnacagaatggtgtgtgctgtgctatccaggaacacatttattatcattatcaantattgtgt

SEQ ID NO: 124 - DNA, 131 bp, Homo sapien
acctttccccaaggccaatgtcctgtgtgctaactggccggctgcaggacagctgcaattcaatgtgctgggtcatatggaggggaggagactctaaaatagccaattttattctcttggttaagatttgt

SEQ ID NO: 125 - DNA, 432 bp, Homo sapien
actttatctactggctatgaaatagatggtggaaaattgcgttaccaactataccactggcttgaaaaagaggtgatagctcttcagaggacttgtgacttttgctcagatgctgaagaactacagtctgcatttggcagaaatgaagatgaatttggattaaatgaggatgctgaagatttgcctcaccaaacaaaagtgaaacaactgagagaaaattttcaggaaaaaagacagtggctcttgaagtatcagtcacttttgagaatgtttcttagttactgcatacttcatggatcccatggtgggggtcttgcatctgtaagaatggaattgattttgcttttgcaagaatctcagcaggaaacatcagaaccactattttctagccctctgtcagagcaaacctcagtgcctctcctctttgcttgt

SEQ ID NO: 126 - DNA, 112 bp, Homo sapien
acacaacttgaatagtaaaatagaaactgagctgaaatttctaattcactttctaaccatagtaagaatgatatttccccccagggatcaccaaatatttataaaaatttgt

SEQ ID NO: 127 - DNA, 54 bp, Homo sapien
accacgaaaccacaaacaagatggaagcatcaatccacttgccaagcacagcag

SEQ ID NO: 128 - DNA, 323 bp, Homo sapien
acctcattagtaattgttttgttgtttcatttttttctaatgtctcccctctaccagctcacctgagataacagaatgaaaatggaaggacagccagatttctcctttgctctctgctcattctctctgaagtctaggttacccattttggggacccattataggcaataaacacagttcccaaagcatttggacagtttcttgttgtgttttagaatggttttcctttttcttagccttttcctgcaaaaggctcactcagtcccttgcttgctcagtggactgggctccccagggcctaggctgccttcttttccatgtcc

SEQ ID NO: 129 - DNA, 192 bp, Homo sapien
  misc_feature (1)...(192): n = A,T,C or G
acatacatgtgtgtatatttttaaatatcacttttgtatcactctgactttttagcatactgaaaacacactaacataatttntgtgaaccatgatcagatacaacccaaatcattcatctagcacattcatctgtgatanaaagataggtgagtttcatttccttcacgttggccaatggataaacaaagt

SEQ ID NO: 130 - DNA, 362 bp, Homo sapien
  misc_feature (1)...(362): n = A,T,C or G
cccttttttatggaatgagtagactgtatgtttgaanatttanccacaacctctttgacatataatgacgcaacaaaaaggtgctgtttagtcctatggttcagtttatgcccctgacaagtttccattgtgttttgccgatcttctggctaatcgtggtatcctccatgttattagtaattctgtattccattttgttaacgcctggtagatgtaacctgctangaggctaactttatacttatttaaaagctcttattttgtggtcattaaaatggcaatttatgtgcagcactttattgcagcaggaagcacgtgtgggttggttgtaaagctctttgctaatcttaaaaagtaatggg

SEQ ID NO: 131 - DNA, 332 bp, Homo sapien
  misc_feature (1)...(332): n = A,T,C or G
ctttttgaaagatcgtgtccactcctgtggacatcttgttttaatggagtttcccatgcagtangactggtatggttgcagctgtccagataaaaacatttgaagagctccaaaatgagagttctcccaggttcgccctgctgctccaagtctcagcagcagcctcttttaggaggcatcttctgaactagattaaggcagcttgtaaatctgatgtgatttggtttattatccaactaacttccatctgttatcactggagaaagcccagactccccangacnggtacggattgtgggcatanaaggattgggtgaagctggcgttgtggt

SEQ ID NO: 132 - DNA, 322 bp, Homo sapien
  misc_feature (1)...(322): n = A,T,C or G
acttttgccattttgtatatataaacaatcttgggacattctcctgaaaactaggtgtccagtggctaagagaactcgatttcaagcaattctgaaaggaaaaccagcatgacacagaatctcaaattcccaaacaggggctctgtgggaaaaatgagggaggacctttgtatctcgggttttagcaagttaaaatgaanatgacaggaaaggcttatttatcaacaaagagaagagttgggatgcttctaaaaaaaactttggtagagaaaataggaatgctnaatcctagggaagcctgtaacaatctacaattggtcca

SEQ ID NO: 133 - DNA, 278 bp, Homo sapien
  misc_feature (1)...(278): n = A,T,C or G
acaagccttcacaagtttaactaaattgggattaatctttctgtanttatctgcataattcttgtttttctttccatctggctcctgggttgacaatttgtggaaacaactctattgctactatttaaaaaaaatcacaaatctttccctttaagctatgttnaattcaaactattcctgctattcctgttttgtcaaagaaattatatttttcaaaatatgtntatttgtttgatgggtcccacgaaacactaataaaaaccacagagaccagcctg

SEQ ID NO: 134 - DNA, 121 bp, Homo sapien
  misc_feature (1)...(121): n = A,T,C or G
gtttanaaaacttgtttagctccatagaggaaagaatgttaaactttgtattttaaaacatgattctctgaggttaaacttggttttcaaatgttatttttacttgtattttgcttttggt

SEQ ID NO: 135 - DNA, 350 bp, Homo sapien
  misc_feature (1)...(350): n = A,T,C or G
acttanaaccatgcctagcacatcagaatccctcaaagaacatcagtataatcctataccatancaagtggtgactggttaagcgtgcgacaaaggtcagctggcacattacttgtgtgcaaacttgatacttttgttctaagtaggaactagtatacagtncctaggantggtactccagggtgccccccaactcctgcagccgctcctctgtgccagnccctgnaaggaactttcgctccacctcaatcaagccctgggccatgctacctgcaattggctgaacaaacgtttgctgagttcccaaggatgcaaagcctggtgctcaactcctggggcgtcaactcagt

SEQ ID NO: 136 - DNA, 399 bp, Homo sapien
  misc_feature (1)...(399): n = A,T,C or G
tgtaccgtgaagacgacagaagttgcatggcagggacagggcagggccgaggccagggttgctgtgattgtatccgaatantcctcgtgagaaaagataatgagatgacgtgagcagcctgcagacttgtgtctgccttcaanaagccagacaggaaggccctgcctgccttggctctgacctggcggccagccagccagccacaggtgggcttcttccttttgtggtgacaacnccaagaaaactgcagaggcccagggtcaggtgtnagtgggtangtgaccataaaacaccaggtgctcccaggaacccgggcaaaggccatccccacctacagccagcatgcccactggcgtgatgggtgcaganggatgaagcagccagntgttctgctgtggt

SEQ ID NO: 137 - DNA, 165 bp, Homo sapien
  misc_feature (1)...(165): n = A,T,C or G
actggtgtggtngggggtgatgctggtggtanaagttgangtgacttcangatggtgtgtggaggaagtgtgtgaacgtagggatgtagangttttggccgtgctaaatgagcttcgggattggctggtcccactggtggtcactgtcattggtggggttcctgt

SEQ ID NO: 138 - DNA, 338 bp, Homo sapien
  misc_feature (1)...(338): n = A,T,C or G
actcactggaatgccacattcacaacagaatcagaggtctgtgaaaacattaatggctccttaacttctccagtaagaatcagggacttgaaatggaaacgttaacagccacatgcccaatgctgggcagtctcccatgccttccacagtgaaagggcttgagaaaaatcacatccaatgtcatgtgtttccagccacaccaaaaggtgcttggggtggagggctgggggcatananggtcangcctcaggaagcctcaagttccattcagctttgccactgtacattccccatntttaaaaaaactgatgccttttttttttttttttgtaaaattc

SEQ ID NO: 139 - DNA, 382 bp, Homo sapien
gggaatcttggtttttggcatctggtttgcctatagccgaggccactttgacagaacaaagaaagggacttcgagtaagaaggtgatttacagccagcctagtgcccgaagtgaaggagaattcaaacagacctcgtcattcctggtgtgagcctggtcggctcaccgcctatcatctgcatttgccttactcaggtgctaccggactctggcccctgatgtctgtagtttcacaggatgccttatttgtcttctacaccccacagggccccctacttcttcggatgtgtttttaataatgtcagctatgtgccccatcctccttcatgccctccctccctttcctaccactgctgagtggcctggaacttgtttaaagtgt

SEQ ID NO: 140 - DNA, 200 bp, Homo sapien
  misc_feature (1)...(200): n = A,T,C or G
accaaancttctttctgttgtgttngattttactataggggtttngcttnttctaaanatacttttcatttaacancttttgttaagtgtcaggctgcactttgctccatanaattattgttttcacatttcaacttgtatgtgtttgtctcttanagcattggtgaaatcacatattttatattcagcataaaggagaa

SEQ ID NO: 141 - DNA, 335 bp, Homo sapien
  misc_feature (1)...(335): n = A,T,C or G
actttattttcaaaacactcatatgttgcaaaaaacacatagaaaaataaagtttggtgggggtgctgactaaacttcaagtcacagacttttatgtgacagattggagcagggtttgttatgcatgtagagaacccaaactaatttattaaacaggatagaaacaggctgtctgggtgaaatggttctgagaaccatccaattcacctgtcagatgctgatanactagctcttcagatgtttttctaccagttcagagatnggttaatgactanttccaatggggaaaaagcaagatggattcacaaaccaagtaattttaaacaaagacactt

SEQ ID NO: 142 - DNA, 459 bp, Homo sapien
  misc_feature (1)...(459): n = A,T,C or G
accaggttaatattgccacatatatcctttccaattgcgggctaaacagacgtgtatttagggttgtttaaagacaacccagcttaatatcaagagaaattgtgacctttcatggagtatctgatggagaaaacactgagttttgacaaatcttattttattcagatagcagtctgatcacacatggtccaacaacactcaaataataaatcaaatatnatcagatgttaaagattggtcttcaaacatcatagccaatgatgccccgcttgcctataatctctccgacataaaaccacatcaacacctcagtggccaccaaaccattcagcacagcttccttaactgtgagctgtttgaagctaccagtctgagcactattgactatntttttcangctctgaatagctctagggatctcagcangggtgggaggaaccagctcaaccttggcgtant

SEQ ID NO: 143 - DNA, 140 bp, Homo sapien
acatttccttccaccaagtcaggactcctggcttctgtgggagttcttatcacctgagggaaatccaaacagtctctcctagaaaggaatagtgtcaccaaccccacccatctccctgagaccatccgacttccctgtgt

SEQ ID NO: 144 - DNA, 164 bp, Homo sapien
  misc_feature (1)...(164): n = A,T,C or G
acttcagtaacaacatacaataacaacattaagtgtatattgccatctttgtcattttctatctataccactctcccttctgaaaacaanaatcactanccaatcacttatacaaatttgaggcaattaatccatatttgttttcaataaggaaaaaaagatgt

SEQ ID NO: 145 - DNA, 303 bp, Homo sapien
  misc_feature (1)...(303): n = A,T,C or G
acgtagaccatccaactttgtatttgtaatggcaaacatccagnagcaattcctaaacaaactggagggtatttatacccaattatcccattcattaacatgccctcctcctcaggctatgcaggacagctatcataagtcggcccaggcatccagatactaccatttgtataaacttcagtaggggagtccatccaagtgacaggtctaatcaaaggaggaaatggaacataagcccagtagtaaaatnttgcttagctgaaacagccacaaaagacttaccgccgtggtgattaccatcaa

SEQ ID NO: 146 - DNA, 327 bp, Homo sapien
  misc_feature (1)...(327): n = A,T,C or G
actgcagctcaattagaagtggtctctgactttcatcancttctccctgggctccatgacactggcctggagtgactcattgctctggttggttgagagagctcctttgccaacaggcctccaagtcagggctgggatttgtttcctttccacattctagcaacaatatgctggccacttcctgaacagggagggtgggaggagccagcatggaacaagctgccactttctaaagtagccagacttgcccctgggcctgtcacacctactgatgaccttctgtgcctgcaggatggaatgtaggggtgagctgtgtgactctatggt

SEQ ID NO: 147 - DNA, 173 bp, Homo sapien
  misc_feature (1)...(173): n = A,T,C or G
acattgtttttttgagataaagcattganagagctctccttaacgtgacacaatggaaggactggaacacatacccacatctttgttctgagggataattttctgataaagtcttgctgtatattcaagcacatatgttatatattattcagttccatgtttatagcctagtt

SEQ ID NO: 148 - DNA, 477 bp, Homo sapien
  misc_feature (1)...(477): n = A,T,C or G
acaaccactttatctcatcgaatttttaacccaaactcactcactgtgcctttctatcctatgggatatattatttgatgctccatttcatcacacatatatgaataatacactcatactgccctactacctgctgcaataatcacattcccttcctgtcctgaccctgaagccattggggtggtcctagtggccatcagtccangcctgcaccttgagcccttgagctccattgctcacnccancccacctcaccgaccccatcctcttacacagctacctccttgctctctaaccccatagattatntccaaattcagtcaattaagttactattaacactctacccgacatgtccagcaccactggtaagccttctccagccaacacacacacacacacacncacacacacacatatccaggcacaggctacctcatcttcacaatcacccctttaattaccatgctatggtgg

SEQ ID NO: 149 - DNA, 207 bp, Homo sapien
acagttgtattataatatcaagaaataaacttgcaatgagagcatttaagagggaagaactaacgtattttagagagccaaggaaggtttctgtggggagtgggatgtaaggtggggcctgatgataaataagagtcagccaggtaagtgggtggtgtggtatgggcacagtgaagaacatttcaggcagagggaacagcagtgaaa

SEQ ID NO: 150 - DNA, 111 bp, Homo sapien
  misc_feature (1)...(111): n = A,T,C or G
accttgatttcattgctgctctgatggaaacccaactatctaatttagctaaaacatgggcacttaaatgtggtcagtgtttggacttgttaactantggcatctttgggt

SEQ ID NO: 151 - DNA, 196 bp, Homo sapien
agcgcggcaggtcatattgaacattccagatacctatcattactcgatgctgttgataacagcaagatggctttgaactcagggtcaccaccagctattggaccttactatgaaaaccatggataccaaccggaaaacccctatcccgcacagcccactgtggtccccactgtctacgaggtgcatccggctcagt

SEQ ID NO: 152 - DNA, 132 bp, Homo sapien
acagcactttcacatgtaagaagggagaaattcctaaatgtaggagaaagataacagaaccttccccttttcatctagtggtggaaacctgatgctttatgttgacaggaatagaaccaggagggagtttgt

SEQ ID NO: 153 - DNA, 285 bp, Homo sapien
  misc_feature (1)...(285): n = A,T,C or G
acaanacccanganaggccactggccgtggtgtcatggcctccaaacatgaaagtgtcagcttctgctcttatgtcctcatctgacaactctttaccatttttatcctcgctcagcaggagcacatcaataaagtccaaagtcttggacttggccttggcttggaggaagtcatcaacaccctggctagtgagggtgcggcgccgctcctggatgacggcatctgtgaagtcgtgcaccagtctgcaggccctgtggaagcgccgtccacacggagtnaggaatt

SEQ ID NO: 154 - DNA, 333 bp, Homo sapien
accacagtcctgttgggccagggcttcatgaccctttctgtgaaaagccatattatcaccaccccaaatttttccttaaatatctttaactgaaggggtcagcctcttgactgcaaagaccctaagccggttacacagctaactcccactggccctgatttgtgaaattgctgctgcctgattggcacaggagtcgaaggtgttcagctcccctcctccgtggaacgagactctgatttgagtttcacaaattctcgggccacctcgtcattgctcctctgaaataaaatccggagaatggtcaggcctgtctcatccatatggatcttccgg

SEQ ID NO: 155 - DNA, 308 bp, Homo sapien
  misc_feature (1)...(308): n = A,T,C or G
actggaaataataaaacccacatcacagtgttgtgtcaaagatcatcagggcatggatgggaaagtgctttgggaactgtaaagtgcctaacacatgatcgatgatttttgttataatatttgaatcacggtgcatacaaactctcctgcctgctcctcctgggccccagccccagccccatcacagctcactgctctgttcatccaggcccagcatgtagtggctgattcttcttggctgcttttagcctccanaagtttctctgaagccaaccaaacctctangtgtaaggcatgctggccctggt

SEQ ID NO: 156 - DNA, 295 bp, Homo sapien
accttgctcggtgcttggaacatattaggaactcaaaatatgagatgataacagtgcctattattgattactgagagaactgttagacatttagttgaagattttctacacaggaactgagaataggagattatgtttggccctcatattctctcctatcctccttgcctcattctatgtctaatatattctcaatcaaataaggttagcataatcaggaaatcgaccaaataccaatataaaaccagatgtctatccttaagattttcaaatagaaaacaaattaacagactat

SEQ ID NO: 157 - DNA, 126 bp, Homo sapien
acaagtttaaatagtgctgtcactgtgcatgtgctgaaatgtgaaatccaccacatttctgaagagcaaaacaaattctgtcatgtaatctctatcttgggtcgtgggtatatctgtccccttagt

SEQ ID NO: 158 - DNA, 442 bp, Homo sapien
  misc_feature (1)...(442): n = A,T,C or G
acccactggtcttggaaacacccatccttaatacgatgatttttctgtcgtgtgaaaatgaanccagcaggctgcccctagtcagtccttccttccagagaaaaagagatttgagaaagtgcctgggtaattcaccattaatttcctcccccaaactctctgagtcttcccttaatatttctggtggttctgaccaaagcaggtcatggtttgttgagcatttgggatcccagtgaagtanatgtttgtagccttgcatacttagcccttcccacgcacaaacggagtggcagagtggtgccaaccctgttttcccagtccacgtagacagattcacagtgcggaattctggaagctgganacagacgggctctttgcagagccgggactctgaganggacatgagggcctctgcctctgtgttcattctctgatgtcctgt

SEQ ID NO: 159 - DNA, 498 bp, Homo sapien
  misc_feature (1)...(498): n = A,T,C or G
acttccaggtaacgttgttgtttccgttgagcctgaactgatgggtgacgttgtaggttctccaacaagaactgaggttgcagagcgggtagggaagagtgctgttccagttgcacctgggctgctgtggactgttgttgattcctcactacggcccaaggttgtggaactggcanaaaggtgtgttgttgganttgagctcgggcggctgtggtaggttgtgggctcttcaacaggggctgctgtggtgccgggangtgaangtgttgtgtcacttgagcttggccagctctggaaagtantanattcttcctgaaggccagcgcttgtggagctggcangggtcantgttgtgtgtaacgaaccagtgctgctgtgggtgggtgtanatcctccacaaagcctgaagttatggtgtcntcaggtaanaatgtggtttcagtgtccctgggcngctgtggaaggttgtanattgtcaccaagggaataagctgtggt

SEQ ID NO: 160 - DNA, 380 bp, Homo sapien
  misc_feature (1)...(380): n = A,T,C or G
acctgcatccagcttccctgccaaactcacaaggagacatcaacctctagacagggaaacagcttcaggatacttccaggagacagagccaccagcagcaaaacaaatattcccatgcctggagcatggcatagaggaagctganaaatgtggggtctgaggaagccatttgagtctggccactagacatctcatcagccacttgtgtgaagagatgccccatgaccccagatgcctctcccacccttacctccatctcacacacttgagctttccactctgtataattctaacatcctggagaaaaatggcagtttgaccgaacctgttcacaacggtagaggctgatttctaacgaaacttgtagaatgaagcctgga

SEQ ID NO: 161 - DNA, 114 bp, Homo sapien
actccacatcccctctgagcaggcggttgtcgttcaaggtgtatttggccttgcctgtcacactgtccactggccccttatccacttggtgcttaatccctcgaaagagcatgt

SEQ ID NO: 162 - DNA, 177 bp, Homo sapien
actttctgaatcgaatcaaatgatacttagtgtagttttaatatcctcatatatatcaaagttttactactctgataattttgtaaaccaggtaaccagaacatccagtcatacagcttttggtgatatataacttggcaataacccagtctggtgatacataaaactactcactgt

SEQ ID NO: 163 - DNA, 137 bp, Homo sapien
  misc_feature (1)...(137): n = A,T,C or G
catttatacagacaggcgtgaagacattcacgacaaaaacgcgaaattctatcccgtgaccanagaaggcagctacggctactcctacatcctggcgtgggtggccttcgcctgcaccttcatcagcggcatgatgt

SEQ ID NO: 164 - DNA, 469 bp, Homo sapien
  misc_feature (1)...(469): n = A,T,C or G
cttatcacaatgaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaagatntttgagcaaacacttt

SEQ ID NO: 165 - DNA, 195 bp, Homo sapien
  misc_feature (1)...(195): n = A,T,C or G
acagttttttatanatatcgacattgccggcacttgtgttcagtttcataaagctggtggatccgctgtcatccactattccttggctagagtaaaaattattcttatagcccatgtccctgcaggccgcccgcccgtagttctcgttccagtcgtcttggcacacagggtgccaggacttcctctgagatgagt

SEQ ID NO: 166 - DNA, 383 bp, Homo sapien
  misc_feature (1)...(383): n = A,T,C or G
acatcttagtagtgtggcacatcagggggccatcagggtcacagtcactcatagcctcgccgaggtcggagtccacaccaccggtgtaggtgtgctcaatcttgggcttggcgcccacctttggagaagggatatgctgcacacacatgtccacaaagcctgtgaactcgccaaagaatttttgcagaccagcctgagcaaggggcggatgttcagcttcagctcctccttcgtcaggtggatgccaacctcgtctanggtccgtgggaagctggtgtccacntcacctacaacctgggcgangatcttataaagaggctccnagataaactccacgaaacttctctgggagctgctagtnggggcctttttggtgaactttc

SEQ ID NO: 167 - DNA, 247 bp, Homo sapien
  misc_feature (1)...(247): n = A,T,C or G
acagagccagaccttggccataaatgaancagagattaagactaaaccccaagtcganattggagcagaaactggagcaagaagtgggcctggggctgaagtagagaccaaggccactgctatanccatacacagagccaactctcaggccaaggcnatggttggggcaganccagagactcaatctgantccaaagtggtggctggaacactggtcatgacanaggcagtgactctgactgangtc

SEQ ID NO: 168 - DNA, 273 bp, Homo sapien
  misc_feature (1)...(273): n = A,T,C or G
acttctaagttttctagaagtggaaggattgtantcatcctgaaaatgggtttacttcaaaatccctcanccttgttcttcacnactgtctatactganagtgtcatgtttccacaaagggctgacacctgagcctgnattttcactcatccctgagaagccctttccagtagggtgggcaattcccaacttccttgccacaagcttcccaggctttctcccctggaaaactccagcttgagtcccagatacactcatgggctgccctgggca

SEQ ID NO: 169 - DNA, 431 bp, Homo sapien
  misc_feature (1)...(431): n = A,T,C or G
acagccttggcttccccaaactccacagtctcagtgcagaaagatcatcttccagcagtcagctcagaccagggtcaaaggatgtgacatcaacagtttctggtttcagaacaggttctactactgtcaaatgaccccccatacttcctcaaaggctgtggtaagttttgcacaggtgagggcagcagaaagggggtanttactgatggacaccatcttctctgtatactccacactgaccttgccatgggcaaaggcccctaccacaaaaacaataggatcactgctgggcaccagctcacgcacatcactgacaaccgggatggaaaaagaantgccaactttcatacatccaactggaaagtgatctgatactggattcttaattaccttcaaaagcttctgggggccatcagctgctcgaacactga

SEQ ID NO: 170 - DNA, 266 bp, Homo sapien
  misc_feature (1)...(266): n = A,T,C or G
acctgtgggctgggctgttatgcctgtgccggctgctgaaagggagttcagaggtggagctcaaggagctctgcaggcattttgccaancctctccanagcanagggagcaacctacactccccgctagaaagacaccagattggagtcctgggagggggagttggggtgggcatttgatgtatacttgtcacctgaatgaangagccagagaggaangagacgaanatganattggccttcaaagctaggggtctggcaggtgga

SEQ ID NO: 171 - DNA, 1248 bp, Homo sapien
  misc_feature (1)...(1248): n = A,T,C or G
ggcagccaaatcataaacggcgaggactgcagcccgcactcgcagccctggcaggcggcactggtcatggaaaacgaattgttctgctcgggcgtcctggtgcatccgcagtgggtgctgtcagccgcacactgtttccagaagtgagtgcagagctcctacaccatcgggctgggcctgcacagtcttgaggccgaccaagagccagggagccagatggtggaggccagcctctccgtacggcacccagagtacaacagacccttgctcgctaacgacctcatgctcatcaagttggacgaatccgtgtccgagtctgacaccatccggagcatcagcattgcttcgcagtgccctaccgcggggaactcttgcctcgtttctggctggggtctgctggcgaacggcagaatgcctaccgtgctgcagtgcgtgaacgtgtcggtggtgtctgaggaggtctgcagtaagctctatgacccgctgtaccaccccagcatgttctgcgccggcggagggcaagaccagaaggactcctgcaacggtgactctggggggcccctgatctgcaacgggtacttgcagggccttgtgtctttcggaaaagccccgtgtggccaagttggcgtgccaggtgtctacaccaacctctgcaaattcactgagtggatagagaaaaccgtccaggccagttaactctggggactgggaacccatgaaattgacccccaaatacatcctgcggaaggaattcaggaatatctgttcccagcccctcctccctcaggcccaggagtccaggcccccagcccctcctccctcaaaccaagggtacagatccccagcccctcctccctcagacccaggagtccagaccccccagcccctcctccctcagacccaggagtccagcccctcctccctcagacccaggagtccagaccccccagcccctcctccctcagacccaggggtccaggcccccaacccctcctccctcagactcagaggtccaagcccccaacccntcattccccagacccagaggtccaggtcccagcccctcntccctcagacccagcggtccaatgccacctagactntccctgtacacagtgcccccttgtggcacgttgacccaaccttaccagttggtttttcatttttngtccctttcccctagatccagaaataaagtttaagagaagngcaaaaaaaaaaaaaaaaaaaaaaaaaaaaaaaaaaaaa

SEQ ID NO: 172 - protein, 159 aa, Homo sapien
  VARIANT (1)...(159): Xaa = Any Amino Acid
MVEASLSVRHPEYNRPLLANDLMLIKLDESVSESDTIRSISIASQCPTAGNSCLVSGWGLLANGRMPTVLQCVNVSVVSEEVCSKLYDPLYHPSMFCAGGGQXQXDSCNGDSGGPLICNGYLQGLVSFGKAPCGQVGVPGVYTNLCKFTEWIEKTVQAS

SEQ ID NO: 173 - DNA, 1265 bp, Homo sapien
  misc_feature (1)...(1265): n = A,T,C or G
ggcagcccgcactcgcagccctggcaggcggcactggtcatggaaaacgaattgttctgctcgggcgtcctggtgcatccgcagtgggtgctgtcagccgcacactgtttccagaactcctacaccatcgggctgggcctgcacagtcttgaggccgaccaagagccagggagccagatggtggaggccagcctctccgtacggcacccagagtacaacagacccttgctcgctaacgacctcatgctcatcaagttggacgaatccgtgtccgagtctgacaccatccggagcatcagcattgcttcgcagtgccctaccgcggggaactcttgcctcgtttctggctggggtctgctggcgaacggtgagctcacgggtgtgtgtctgccctcttcaaggaggtcctctgcccagtcgcgggggctgacccagagctctgcgtcccaggcagaatgcctaccgtgctgcagtgcgtgaacgtgtcggtggtgtctgaggaggtctgcagtaagctctatgacccgctgtaccaccccagcatgttctgcgccggcggagggcaagaccagaaggactcctgcaacggtgactctggggggcccctgatctgcaacgggtacttgcagggccttgtgtctttcggaaaagccccgtgtggccaagttggcgtgccaggtgtctacaccaacctctgcaaattcactgagtggatagagaaaaccgtccaggccagttaactctggggactgggaacccatgaaattgacccccaaatacatcctgcggaaggaattcaggaatatctgttcccagcccctcctccctcaggcccaggagtccaggcccccagcccctcctccctcaaaccaagggtacagatccccagcccctcctccctcagacccaggagtccagaccccccagcccctcctccctcagacccaggagtccagcccctcctccntcagacccaggagtccagaccccccagcccctcctccctcagacccaggggttgaggcccccaacccctcctccttcagagtcagaggtccaagcccccaacccctcgttccccagacccagaggtnnaggtcccagcccctcttccntcagacccagnggtccaatgccacctagattttccctgnacacagtgcccccttgtggnangttgacccaaccttaccagttggtttttcatttttngtccctttcccctagatccagaaataaagtttaagagangngcaaaaaaaaaa

SEQ ID NO: 174 - DNA, 1459 bp, Homo sapien
  misc_feature (1)...(1459): n = A,T,C or G
ggtcagccgcacactgtttccagaagtgagtgcagagctcctacaccatcgggctgggcctgcacagtcttgaggccgaccaagagccagggagccagatggtggaggccagcctctccgtacggcacccagagtacaacagacccttgctcgctaacgacctcatgctcatcaagttggacgaatccgtgtccgagtctgacaccatccggagcatcagcattgcttcgcagtgccctaccgcggggaactcttgcctcgtttctggctggggtctgctggcgaacggtgagctcacgggtgtgtgtctgccctcttcaaggaggtcctctgcccagtcgcgggggctgacccagagctctgcgtcccaggcagaatgcctaccgtgctgcagtgcgtgaacgtgtcggtggtgtctgangaggtctgcantaagctctatgacccgctgtaccaccccancatgttctgcgccggcggagggcaagaccagaaggactcctgcaacgtgagagaggggaaaggggagggcaggcgactcagggaagggtggagaagggggagacagagacacacagggccgcatggcgagatgcagagatggagagacacacagggagacagtgacaactagagagagaaactgagagaaacagagaaataaacacaggaataaagagaagcaaaggaagagagaaacagaaacagacatggggaggcagaaacacacacacatagaaatgcagttgaccttccaacagcatggggcctgagggcggtgacctccacccaatagaaaatcctcttataacttttgactccccaaaaacctgactagaaatagcctactgttgacggggagccttaccaataacataaatagtcgatttatgcatacgttttatgcattcatgatatacctttgttggaattttttgatatttctaagctacacagttcgtctgtgaatttttttaaattgttgcaactctcctaaaatttttctgatgtgtttattgaaaaaatccaagtataagtggacttgtgcattcaaaccagggttgttcaagggtcaactgtgtacccagagggaaacagtgacacagattcatagaggtgaaacacgaagagaaacaggaaaaatcaagactctacaaagaggctgggcagggtggctcatgcctgtaatcccagcactttgggaggcgaggcaggcagatcacttgaggtaaggagttcaagaccagcctggccaaaatggtgaaatcctgtctgtactaaaaatacaaaagttagctggatatggtggcaggcgcctgtaatcccagctacttgggaggctgaggcaggagaattgcttgaatatgggaggcagaggttgaagtgagttgagatcacaccactatactccagctggggcaacagagtaagactctgtctcaaaaaaaaaaaaaaaaaa

SEQ ID NO: 175 - DNA, 1167 bp, Homo sapien
  misc_feature (1)...(1167): n = A,T,C or G
gcgcagccctggcaggcggcactggtcatggaaaacgaattgttctgctcgggcgtcctggtgcatccgcagtgggtgctgtcagccgcacactgtttccagaactcctacaccatcgggctgggcctgcacagtcttgaggccgaccaagagccagggagccagatggtggaggccagcctctccgtacggcacccagagtacaacagactcttgctcgctaacgacctcatgctcatcaagttggacgaatccgtgtccgagtctgacaccatccggagcatcagcattgcttcgcagtgccctaccgcggggaactcttgcctcgtntctggctggggtctgctggcgaacggcagaatgcctaccgtgctgcactgcgtgaacgtgtcggtggtgtctgaggangtctgcagtaagctctatgacccgctgtaccaccccagcatgttctgcgccggcggagggcaagaccagaaggactcctgcaacggtgactctggggggcccctgatctgcaacgggtacttgcagggccttgtgtctttcggaaaagccccgtgtggccaacttggcgtgccaggtgtctacaccaacctctgcaaattcactgagtggatagagaaaaccgtccagnccagttaactctggggactgggaacccatgaaattgacccccaaatacatcctgcggaangaattcaggaatatctgttcccagcccctcctccctcaggcccaggagtccaggcccccagcccctcctccctcaaaccaagggtacagatccccagcccctcctccctcagacccaggagtccagaccccccagcccctcntccntcagacccaggagtccagcccctcctccntcagacgcaggagtccagaccccccagcccntcntccgtcagacccaggggtgcaggcccccaacccctcntccntcagagtcagaggtccaagcccccaacccctcgttccccagacccagaggtncaggtcccagcccctcctccctcagacccagcggtccaatgccacctagantntccctgtacacagtgcccccttgtggcangttgacccaaccttaccagttggtttttcattttttgtccctttcccctagatccagaaataaagtntaagagaagcgcaaaaaaa

SEQ ID NO: 176 - protein, 205 aa, Homo sapien
  VARIANT (1)...(205): Xaa = Any Amino Acid
MENELFCSGVLVHPQWVLSAAHCFQNSYTIGLGLHSLEADQEPGSQMVEASLSVRHPEYNRLLLANDLMLIKLDESVSESDTIRSISIASQCPTAGNSCLVSGWGLLANGRMPTVLHCVNVSVVSEXVCSKLYDPLYHPSMFCAGGGQDQKDSCNGDSGGPLICNGYLQGLVSFGKAPCGQLGVPGVYTNLCKFTEWIEKTVQXS

SEQ ID NO: 177 - DNA, 1119 bp, Homo sapien
gcgcactcgcagccctggcaggcggcactggtcatggaaaacgaattgttctgctcgggcgtcctggtgcatccgcagtgggtgctgtcagccgcacactgtttccagaactcctacaccatcgggctgggcctgcacagtcttgaggccgaccaagagccagggagccagatggtggaggccagcctctccgtacggcacccagagtacaacagacccttgctcgctaacgacctcatgctcatcaagttggacgaatccgtgtccgagtctgacaccatccggagcatcagcattgcttcgcagtgccctaccgcggggaactcttgcctcgtttctggctggggtctgctggcgaacgatgctgtgattgccatccagtcccagactgtgggaggctgggagtgtgagaagctttcccaaccctggcagggttgtaccatttcggcaacttccagtgcaaggacgtcctgctgcatcctcactgggtgctcactactgctcactgcatcacccggaacactgtgatcaactagccagcaccatagttctccgaagtcagactatcatgattactgtgttgactgtgctgtctattgtactaaccatgccgatgtttaggtgaaattagcgtcacttggcctcaaccatcttggtatccagttatcctcactgaattgagatttcctgcttcagtgtcagccattcccacataatttctgacctacagaggtgagggatcatatagctcttcaaggatgctggtactcccctcacaaattcatttctcctgttgtagtgaaaggtgcgccctctggagcctcccagggtgggtgtgcaggtcacaatgatgaatgtatgatcgtgttcccattacccaaagcctttaaatccctcatgctcagtacaccagggcaggtctagcatttcttcatttagtgtatgctgtccattcatgcaaccacctcaggactcctggattctctgcctagttgagctcctgcatgctgcctccttggggaggtgagggagagggcccatggttcaatgggatctgtgcagttgtaacacattaggtgcttaataaacagaagctgtgatgttaaaaaaaaaaaaaaa

SEQ ID NO: 178 - protein, 164 aa, Homo sapien
  VARIANT (1)...(164): Xaa = Any Amino Acid
MENELFCSGVLVHPQWVLSAAHCFQNSYTIGLGLHSLEADQEPGSQMVEASLSVRHPEYNRPLLANDLMLIKLDESVSESDTIRSISIASQCPTAGNSCLVSGWGLLANDAVIAIQSXTVGGWECEKLSQPWQGCTISATSSARTSCCILTGCSLLLTASPGTL

SEQ ID NO: 179 - DNA, 250 bp, Homo sapien
ctggagtgccttggtgtttcaagcccctgcaggaagcagaatgcaccttctgaggcacctccagctgcccccggccgggggatgcgaggctcggagcacccttgcccggctgtgattgctgccaggcactgttcatctcagcttttctgtccctttgctcccggcaagcgcttctgctgaaagttcatatctggagcctgatgtcttaacgaataaaggtcccatgctccacccgaaaaaaaaaaaaaaa

SEQ ID NO: 180 - DNA, 202 bp, Homo sapien
actagtccagtgtggtggaattccattgtgttgggcccaacacaatggctacctttaacatcacccagaccccgcccctgcccgtgccccacgctgctgctaacgacagtatgatgcttactctgctactcggaaactatttttatgtaattaatgtatgctttcttgtttataaatgcctgatttaaaaaaaaaaaaaaaa

SEQ ID NO: 181 - DNA, 558 bp, Homo sapien
  misc_feature (1)...(558): n = A,T,C or G
tccytttgktnaggtttkkgagacamccckagacctwaanctgtgtcacagacttcynggaatgtttaggcagtgctagtaatttcytcgtaatgattctgttattactttcctnattctttattcctctttcttctgaagattaatgaagttgaaaattgaggtggataaatacaaaaaggtagtgtgatagtataagtatctaagtgcagatgaaagtgtgttatatatatccattcaaaattatgcaagttagtaattactcagggttaactaaattactttaatatgctgttgaacctactctgttccttggctagaaaaaattataaacaggactttgttagtttgggaagccaaattgataatattctatgttctaaaagttgggctatacataaattattaagaaatatggawttttattcccaggaatatggkgttcattttatgaatattacscrggatagawgtwtgagtaaaaycagttttggtwaataygtwaatatgtcmtaaataaacaakgctttgacttatttccaaaaaaaaaaaaaaaaa

SEQ ID NO: 182 - DNA, 479 bp, Homo sapien
  misc_feature (1)...(479): n = A,T,C or G
acagggwttkgrggatgctaagsccccrgarwtygtttgatccaaccctggcttwttttcagaggggaaaatggggcctagaagttacagmscatytagytggtgcgmtggcacccctggcstcacacagastcccgagtagctgggactacaggcacacagtcactgaagcaggccctgttwgcaattcacgttgccacctccaacttaaacattcttcatatgtgatgtccttagtcactaaggttaaactttcccacccagaaaaggcaacttagataaaatcttagagtactttcatactmttctaagtcctcttccagcctcactkkgagtcctmcytgggggttgataggaantntctcttggctttctcaataaartctctatycatctcatgtttaatttggtacgcataraawtgstgaraaaattaaaatgttctggttymactttaaaaaraaaaaaaaaaaaaaaaa

SEQ ID NO: 183 - DNA, 384 bp, Homo sapien
aggcgggagcagaagctaaagccaaagcccaagaagagtggcagtgccagcactggtgccagtaccagtaccaataacagtgccagtgccagtgccagcaccagtggtggcttcagtgctggtgccagcctgaccgccactctcacatttgggctcttcgctggccttggtggagctggtgccagcaccagtggcagctctggtgcctgtggtttctcctacaagtgagattttagatattgttaatcctgccagtctttctcttcaagccagggtgcatcctcagaaacctactcaacacagcactctaggcagccactatcaatcaattgaagttgacactctgcattaratctatttgccatttcaaaaaaaaaaaaaaaa

SEQ ID NO: 184 - DNA, 496 bp, Homo sapien
  misc_feature (1)...(496): n = A,T,C or G
accgaattgggaccgctggcttataagcgatcatgtyyntccrgtatkacctcaacgagcagggagatcgagtctatacgctgaagaaatttgacccgatgggacaacagacctgctcagcccatcctgctcggttctccccagatgacaaatactctsgacaccgaatcaccatcaagaaacgcttcaaggtgctcatgacccagcaaccgcgccctgtcctctgagggtcccttaaactgatgtcttttctgccacctgttacccctcggagactccgtaaccaaactcttcggactgtgagccctgatgcctttttgccagccatactctttggcatccagtctctcgtggcgattgattatgcttgtgtgaggcaatcatggtggcatcacccataaagggaacacatttgacttttttttctcatattttaaattactacmagawtattwmagawwaaatgawttgaaaaactsttaaaaaaaaaaaaaaa

SEQ ID NO: 185 - DNA, 384 bp, Homo sapien
gctggtagcctatggcgkggcccacggaggggctcctgaggccacggracagtgacttcccaagtatcytgcgcsgcgtcttctaccgtccctacctgcagatcttcgggcagattccccaggaggacatggacgtggccctcatggagcacagcaactgytcgtcggagcccggcttctgggcacaccctcctggggcccaggcgggcacctgcgtctcccagtatgccaactggctggtggtgctgctcctcgtcatcttcctgctcgtggccaacatcctgctggtcaacttgctcattgccatgttcagttacacattcggcaaagtacagggcaacagcgatctctactgggaaggcgcagcgttaccgcctcatccgg

SEQ ID NO: 186 - DNA, 577 bp, Homo sapien
  misc_feature (1)...(577): n = A,T,C or G
gagttagctcctccacaaccttgatgaggtcgtctgcagtggcctctcgcttcataccgctnccatcgtcatactgtaggtttgccaccacytcctggcatcttggggcggcntaatattccaggaaactctcaatcaagtcaccgtcgatgaaacctgtgggctggttctgtcttccgctcggtgtgaaaggatctcccagaaggagtgctcgatcttccccacacttttgatgactttattgagtcgattctgcatgtccagcaggaggttgtaccagctctctgacagtgaggtcaccagccctatcatgccgttgamcgtgccgaagarcaccgagccttgtgtgggggkkgaagtctcacccagattctgcattaccagagagccgtggcaaaagacattgacaaactcgcccaggtggaaaaagamcamctcctggargtgctngccgctcctcgtcmgttggtggcagcgctwtccttttgacacacaaacaagttaaaggcattttcagcccccagaaanttgtcatcatccaagatntcgcacagcactnatccagttgggattaaat

SEQ ID NO: 187 - DNA, 534 bp, Homo sapien
  misc_feature (1)...(534): n = A,T,C or G
aacatcttcctgtataatgctgtgtaatatcgatccgatnttgtctgstgagaatycatwactkggaaaagmaacattaaagcctggacactggtattaaaattcacaatatgcaacactttaaacagtgtgtcaatctgctcccyynactttgtcatcaccagtctgggaakaagggtatgccctattcacacctgttaaaagggcgctaagcatttttgattcaacatctttttttttgacacaagtccgaaaaaagcaaaagtaaacagttatyaatttgttagccaattcactttcttcatgggacagagccatytgatttaaaaagcaaattgcataatattgagcttygggagctgatatttgagcggaagagtagcctttctacttcaccagacacaactccctttcatattgggatgttnacnaaagtwatgtctctwacagatgggatgcttttgtggcaattctgttctgaggatctcccagtttatttaccacttgcacaagaaggcgttttcttcctcaggc

SEQ ID NO: 188 - DNA, 761 bp, Homo sapien
  misc_feature (1)...(761): n = A,T,C or G
agaaaccagtatctctnaaaacaacctctcataccttgtggacctaattttgtgtgcgtgtgtgtgtgcgcgcatattatatagacaggcacatcttttttacttttgtaaaagcttatgcctctttggtatctatatctgtgaaagttttaatgatctgccataatgtcttggggacctttgtcttctgtgtaaatggtactagagaaaacacctatnttatgagtcaatctagttngttttattcgacatgaaggaaatttccagatnacaacactnacaaactctccctkgackargggggacaaagaaaagcaaaactgamcataaraaacaatwacctggtgagaarttgcataaacagaaatwrggtagtatattgaarnacagcatcattaaarmgttwtkttwttctcccttgcaaaaaacatgtacngacttcccgttgagtaatgccaagttgttttttttatnataaaacttgcccttcattacatgtttnaaagtggtgtggtgggccaaaatattgaaatgatggaactgactgataaagctgtacaaataagcagtgtgcctaacaagcaacacagtaatgttgacatgcttaattcacaaatgctaatttcattataaatgtttgctaaaatacactttgaactatttttctgtnttcccagagctgagatnttagattttatgtagtatnaagtgaaaaantacgaaaataataacattgaagaaaaananaaaaaanaaaaaaa

SEQ ID NO: 189 - DNA, 482 bp, Homo sapien
  misc_feature (1)...(482): n = A,T,C or G
tttttttttttttgccgatnctactattttattgcaggangtgggggtgtatgcaccgcacaccggggctatnagaagcaagaaggaaggagggagggcacagccccttgctgagcaacaaagccgcctgctgccttctctgtctgtctcctggtgcaggcacatggggagaccttccccaaggcaggggccaccagtccaggggtgggaatacagggggtgggangtgtgcataagaagtgataggcacaggccacccggtacagacccctcggctcctgacaggtngatttcgaccaggtcattgtgccctgcccaggcacagcgtanatctggaaaagacagaatgctttccttttcaaatttggctngtcatngaangggcanttttccaanttnggctnggtcttggtacncttggttcggcccagctccncgtccaaaaantattcacccnnctccnaattgcttgcnggnccccc

SEQ ID NO: 190 - DNA, 471 bp, Homo sapien
  misc_feature (1)...(471): n = A,T,C or G
ttttttttttttttaaaacagtttttcacaacaaaatttattagaagaatagtggttttgaaaactctcgcatccagtgagaactaccatacaccacattacagctnggaatgtnctccaaatgtctggtcaaatgatacaatggaaccattcaatcttacacatgcacgaaagaacaagcgcttttgacatacaatgcacaaaaaaaaaaggggggggggaccacatggattaaaattttaagtactcatcacatacattaagacacagttctagtccagtcnaaaatcagaactgcnttgaaaaatttcatgtatgcaatccaaccaaagaacttnattggtgatcatgantnctctactacatcnaccttgatcattgccaggaacnaaaagttnaaancacncngtacaaaaanaatctgtaattnanttcaacctccgtacngaaaaatnttnnttatacactccc

SEQ ID NO: 191 - DNA, 402 bp, Homo sapien
  misc_feature (1)...(402): n = A,T,C or G
gagggattgaaggtctgttctastgtcggmctgttcagccaccaactctaacaagttgctgtcttccactcactgtctgtaagctttttaacccagacwgtatcttcataaatagaacaaattcttcaccagtcacatcttctaggacctttttggattcagttagtataagctcttccacttcctttgttaagacttcatctggtaaagtcttaagttttgtagaaaggaattyaattgctcgttctctaacaatgtcctctccttgaagtatttggctgaacaacccacctaaagtccctttgtgcatccattttaaatatacttaatagggcattgktncactaggttaaattctgcaagagtcatctgtctgcaaaagttgcgttagtatatctgcca

SEQ ID NO: 192 - DNA, 601 bp, Homo sapien
  misc_feature (1)...(601): n = A,T,C or G
gagctcggatccaataatctttgtctgagggcagcacacatatncagtgccatggnaactggtctaccccacatgggagcagcatgccgtagntatataaggtcattccctgagtcagacatgcytytttgaytaccgtgtgccaagtgctggtgattctyaacacacytccatcccgytcttttgtggaaaaactggcacttktctggaactagcargacatcacttacaaattcacccacgagacacttgaaaggtgtaacaaagcgaytcttgcattgctttttgtccctccggcaccagttgtcaatactaacccgctggtttgcctccatcacatttgtgatctgtagctctggatacatctcctgacagtactgaagaacttcttcttttgtttcaaaagcarctcttggtgcctgttggatcaggttcccatttcccagtcygaatgttcacatggcatatttwacttcccacaaaacattgcgatttgaggctcagcaacagcaaatcctgttccggcattggctgcaagagcctcgatgtagccggccagcgccaaggcaggcgccgtgagccccaccagcagcagaagcag

SEQ ID NO: 193 - DNA, 608 bp, Homo sapien
  misc_feature (1)...(608): n = A,T,C or G
atacagcccanatcccaccacgaagatgcgcttgttgactgagaacctgatgcggtcactggtcccgctgtagccccagcgactctccacctgctggaagcggttgatgctgcactcyttcccaacgcaggcagmagcgggsccggtcaatgaactccaytcgtggcttggggtkgacggtkaagtgcaggaagaggctgaccacctcgcggtccaccaggatgcccgactgtgcgggacctgcagcgaaactcctcgatggtcatgagcgggaagcgaatgaggcccagggccttgcccagaaccttccgcctgttctctggcgtcacctgcagctgctgccgctgacactcggcctcggaccagcggacaaacggcrttgaacagccgcacctcacggatgcccagtgtgtcgcgctccaggammgscaccagcgtgtccaggtcaatgtcggtgaagccctccgcgggtratggcgtctgcagtgtttttgtcgatgttctccaggcacaggctggccagctgcggttcatcgaagagtcgcgcctgcgtgagcagcatgaaggcgttgtcggctcgcagttcttcttcaggaactccacgcaat

SEQ ID NO: 194 - DNA, 392 bp, Homo sapien
  misc_feature (1)...(392): n = A,T,C or G
gaacggctggaccttgcctcgcattgtgcttgctggcagggaataccttggcaagcagytccagtccgagcagccccagaccgctgccgcccgaagctaagcctgcctctggccttcccctccgcctcaatgcagaaccagtagtgggagcactgtgtttagagttaagagtgaacactgtttgattttacttgggaatttcctctgttatatagcttttcccaatgctaatttccaaacaacaacaacaaaataacatgtttgcctgttaagttgtataaaagtaggtgattctgtatttaaagaaaatattactgttacatatactgcttgcaatttctgtatttattgktnctstggaaataaatatagttattaaaggttgtcantcc

SEQ ID NO: 195 - DNA, 502 bp, Homo sapien
  misc_feature (1)...(502): n = A,T,C or G
ccsttkgaggggtkaggkyccagttyccgagtggaagaaacaggccaggagaagtgcgtgccgagctgaggcagatgttcccacagtgacccccagagccstgggstatagtytctgacccctcncaaggaaagaccacsttctggggacatgggctggagggcaggacctagaggcaccaagggaaggccccattccggggstgttccccgaggaggaagggaaggggctctgtgtgccccccasgaggaagaggccctgagtcctgggatcagacaccccttcacgtgtatccccacacaaatgcaagctcaccaaggtcccctctcagtccccttccstacaccctgamcggccactgscscacacccacccagagcacgccacccgccatggggartgtgctcaaggartcgcngggcarcgtggacatctngtcccagaagggggcagaatctccaataganggactgarcmsttgctnanaaaaaaaaanaaaaaa

SEQ ID NO: 196 - DNA, 665 bp, Homo sapien
  misc_feature (1)...(665): n = A,T,C or G
ggttacttggtttcattgccaccacttagtggatgtcatttagaaccattttgtctgctccctctggaagccttgcgcagagcggactttgtaattgttggagaataactgctgaattttwagctgtttkgagttgattsgcaccactgcacccacaacttcaatatgaaaacyawttgaactwatttattatcttgtgaaaagtataacaatgaaaattttgttcatactgtattkatcaagtatgatgaaaagcaawagatatatattcttttattatgttaaattatgattgccattattaatcggcaaaatgtggagtgtatgttcttttcacagtaatatatgccttttgtaacttcacttggttattttattgtaaatgarttacaaaattcttaatttaagaraatggtatgtwatatttatttcattaatttctttcctkgtttacgtwaattttgaaaagawtgcatgatttcttgacagaaatcgatcttgatgctgtggaagtagtttgacccacatccctatgagtttttcttagaatgtataaaggttgtagcccatcnaacttcaaagaaaaaaatgaccacatactttgcaatcaggctgaaatgtggcatgctnttctaattccaactttataaactagcaaanaagtg

SEQ ID NO: 197 - DNA, 492 bp, Homo sapien
  misc_feature (1)...(492): n = A,T,C or G
ttttntttttttttttttgcaggaaggattccatttattgtggatgcattttcacaatatatgtttattggagcgatccattatcagtgaaaagtatcaagtgtttataanatttttaggaaggcagattcacagaacatgctngtcngcttgcagttttacctcgtanagatnacagagaattatagtcnaaccagtaaacnaggaatttacttttcaaaagattaaatccaaactgaacaaaattctaccctgaaacttactccatccaaatattggaataanagtcagcagtgatacattctcttctgaactttagattttctagaaaaatatgtaatagtgatcaggaagagctcttgttcaaaagtacaacnaagcaatgttcccttaccataggccttaattcaaactttgatccatttcactcccatcacgggagtcaatgctacctgggacacttgtattttgttcatnctgancntggcttaa

SEQ ID NO: 198 - DNA, 478 bp, Homo sapien
  misc_feature (1)...(478): n = A,T,C or G
tttnttttgnatttcantctgtannaantattttcattatgtttattanaaaaatatnaatgtntccacnacaaatcatnttacntnagtaagaggccanctacattgtacaacatacactgagtatattttgaaaaggacaagtttaaagtanacncatattgccgancatancacatttatacatggcttgattgatatttagcacagcanaaactgagtgagttaccagaaanaaatnatatatgtcaatcngatttaagatacaaaacagatcctatggtacatancatcntgtaggagttgtggctttatgtttactgaaagtcaatgcagttcctgtacaaagagatggccgtaagcattctagtacctctactccatggttaagaatcgtacacttatgtttacatatgtncagggtaagaattgtgttaagtnaanttatggagaggtccangagaaaaatttgatncaa

SEQ ID NO: 199 - DNA, 482 bp, Homo sapien
  misc_feature (1)...(482): n = A,T,C or G
agtgacttgtcctccaacaaaaccccttgatcaagtttgtggcactgacaatcagacctatgctagttcctgtcatctattcgctactaaatgcagactggaggggaccaaaaaggggcatcaactccagctggattattttggagcctgcaaatctattcctacttgtacggactttgaagtgattcagtttcctctacggatgagagactggctcaagaatatcctcatgcagctttatgaagccnactctgaacacgctggttatctnagatgagaancagagaaataaagtcnagaaaatttacctggangaaaagaggctttnggctggggaccatcccattgaaccttctcttaanggactttaagaanaaactaccacatgtntgtngtatcctggtgccnggccgtttantgaacntngacnncacccttntggaatanantcttgacngcntcctgaacttgctcctctgcga

SEQ ID NO: 200 - DNA, 270 bp, Homo sapien
  misc_feature (1)...(270): n = A,T,C or G
cggccgcaagtgcaactccagctggggccgtgcggacgaagattctgccagcagttggtccgactgcgacgacggcggcggcgacagtcgcaggtgcagcgcgggcgcctggggtcttgcaaggctgagctgacgccgcagaggtcgtgtcacgtcccacgaccttgacgccgtcggggacagccggaacagagcccggtgaangcgggaggcctcggggagcccctcgggaagggcggcccgagagatacgcaggtgcaggtggccgcc

SEQ ID NO: 201 - DNA, 419 bp, Homo sapien
  misc_feature (1)...(419): n = A,T,C or G
ttttttttttttttggaatctactgcgagcacagcaggtcagcaacaagtttattttgcagctagcaaggtaacagggtagggcatggttacatgttcaggtcaacttcctttgtcgtggttgattggtttgtctttatgggggcggggtggggtaggggaaancgaagcanaantaacatggagtgggtgcaccctccctgtagaacctggttacnaaagcttggggcagttcacctggtctgtgaccgtcattttcttgacatcaatgttattagaagtcaggatatcttttagagagtccactgtntctggagggagattagggtttcttgccaanatccaancaaaatccacntgaaaaagttggatgatncangtacngaataccganggcatanttctcatantcggtggcca

SEQ ID NO: 202 - DNA, 509 bp, Homo sapien
  misc_feature (1)...(509): n = A,T,C or G
tttntttttttttttttttttttttttttttttttttttttttttttttttttttttttttggcacttaatccatttttatttcaaaatgtctacaaantttnaatncnccattatacnggtnattttncaaaatctaaannttattcaaatntnagccaaantccttacncaaatnnaatacncncaaaaatcaaaaatatacntntctttcagcaaacttngttacataaattaaaaaaatatatacggctggtgttttcaaagtacaattatcttaacactgcaaacatntttnnaaggaactaaaataaaaaaaaacactnccgcaaaggttaaagggaacaacaaattcnttttacaacancnncnattataaaaatcatatctcaaatcttaggggaatatatacttcacacngggatcttaacttttactncactttgtttatttttttanaaccattgtnttgggcccaacacaatggnaatnccnccncnctggactagt

SEQ ID NO: 203 - DNA, 583 bp, Homo sapien
  misc_feature (1)...(583): n = A,T,C or G
ttttttttttttttttttgacccccctcttataaaaaacaagttaccattttattttacttacacatatttattttataattggtattagatattcaaaaggcagcttttaaaatcaaactaaatggaaactgccttagatacataattcttaggaattagcttaaaatctgcctaaagtgaaaatcttctctagctcttttgactgtaaatttttgactcttgtaaaacatccaaattcatttttcttgtctttaaaattatctaatctttccattttttccctattccaagtcaatttgcttctctagcctcatttcctagctcttatctactattagtaagtggcttttttcctaaaagggaaaacaggaagaganaatggcacacaaaacaaacattttatattcatatttctacctacgttaataaaatagcattttgtgaagccagctcaaaagaaggcttagatccttttatgtccattttagtcactaaacgatatcnaaagtgccagaatgcaaaaggtttgtgaacatttattcaaaagctaatataagatatttcacatactcatctttctg

SEQ ID NO: 204 - DNA, 589 bp, Homo sapien
  misc_feature (1)...(589): n = A,T,C or G
ttttttttntttttttttttttttttnctcttctttttttttganaatgaggatcgagtttttcactctctagatagggcatgaagaaaactcatctttccagctttaaaataacaatcaaatctcttatgctatatcatattttaagttaaactaatgagtcactggcttatcttctcctgaaggaaatctgttcattcttctcattcatatagttatatcaagtactaccttgcatattgagaggtttttcttctctatttacacatatatttccatgtgaatttgtatcaaacctttattttcatgcaaactagaaaataatgtnttcttttgcataagagaagagaacaatatnagcattacaaaactgctcaaattgtttgttaagnttatccattataattagttnggcaggagctaatacaaatcacatttacngacnagcaataataaaactgaagtaccagttaaatatccaaaataattaaaggaacatttttagcctgggtataattagctaattcactttacaagcatttattnagaatgaattcacatgttattattccntagcccaacacaatgg

SEQ ID NO: 205 - DNA, 545 bp, Homo sapien
  misc_feature (1)...(545): n = A,T,C or G
tttttnttttttttttcagtaataatcagaacaatatttatttttatatttaaaattcatagaaaagtgccttacatttaataaaagtttgtttctcaaagtgatcagaggaattagatatngtcttgaacaccaatattaatttgaggaaaatacaccaaaatacattaagtaaattatttaagatcatagagcttgtaagtgaaaagataaaatttgacctcagaaactctgagcattaaaaatccactattagcaaataaattactatggacttcttgctttaattttgtgatgaatatggggtgtcactggtaaaccaacacattctgaaggatacattacttagtgatagattcttatgtactttgctanatnacgtggatatgagttgacaagtttctctttcttcaatcttttaaggggcngangaaatgaggaagaaaagaaaaggattacgcatactgttctttctatnggaaggattagatatgtttcctttgccaatattaaaaaaataataatgtttactactagtgaaaccc

SEQ ID NO: 206 - DNA, 487 bp, Homo sapien
  misc_feature (1)...(487): n = A,T,C or G
ttttttttttttttttagtcaagtttctnatttttattataattaaagtcttggtcatttcatttattagctctgcaacttacatatttaaattaaagaaacgttnttagacaactgtnacaatttataaatgtaaggtgccattattgagtanatatattcctccaagagtggatgtgtcccttctcccaccaactaatgaancagcaacattagtttaattttattagtagatnatacactgctgcaaacgctaattctcttctccatccccatgtngatattgtgtatatgtgtgagttggtnagaatgcatcancaatctnacaatcaacagcaagatgaagctaggcntgggctttcggtgaaaatagactgtgtctgtctgaatcaaatgatctgacctatcctcggtggcaagaactcttcgaaccgcttcctcaaaggcngctgccacatttgtggcntctnttgcacttgtttcaaaa

SEQ ID NO: 207 - DNA, 332 bp, Homo sapien
  misc_feature (1)...(332): n = A,T,C or G
tgaattggctaaaagactgcatttttanaactagcaactcttatttctttcctttaaaaatacatagcattaaatcccaaatcctatttaaagacctgacagcttgagaaggtcactactgcatttataggaccttctggtggttctgctgttacntttgaantctgacaatccttganaatctttgcatgcagaggaggtaaaaggtattggattttcacagaggaanaacacagcgcagaaatgaaggggccaggcttactgagcttgtccactggagggctcatgggtgggacatggaaaagaaggcagcctaggccctggggagccca

SEQ ID NO: 208 - DNA, 524 bp, Homo sapien
  misc_feature (1)...(524): n = A,T,C or G
agggcgtggtgcggagggcgttactgttttgtctcagtaacaataaatacaaaaagactggttgtgttccggccccatccaaccacgaagttgatttctcttgtgtgcagagtgactgattttaaaggacatggagcttgtcacaatgtcacaatgtcacagtgtgaagggcacactcactcccgcgtgattcacatttagcaaccaacaatagctcatgagtccatacttgtaaatacttttggcagaatacttnttgaaacttgcagatgataactaagatccaagatatttcccaaagtaaatagaagtgggtcataatattaattacctgttcacatcagcttccatttacaagtcatgagcccagacactgacatcaaactaagcccacttagactcctcaccaccagtctgtcctgtcatcagacaggaggctgtcaccttgaccaaattctcaccagtcaatcatctatccaaaaaccattacctgatccacttccggtaatgcaccaccttggtga

SEQ ID NO: 209 - DNA, 159 bp, Homo sapien
gggtgaggaaatccagagttgccatggagaaaattccagtgtcagcattcttgctccttgtggccctctcctacactctggccagagataccacagtcaaacctggagccaaaaaggacacaaaggactctcgacccaaactgccccagaccctctcca

SEQ ID NO: 210 - DNA, 256 bp, Homo sapien
  misc_feature (1)...(256): n = A,T,C or G
actccctggcagacaaaggcagaggagagagctctgttagttctgtgttgttgaactgccactgaatttctttccacttggactattacatgccanttgagggactaatggaaaaacgtatggggagattttanccaatttangtntgtaaatggggagactggggcaggcgggagagatttgcagggtgnaaatggganggctggtttgttanatgaacagggacataggaggtaggcaccaggatgctaaatca

SEQ ID NO: 211 - DNA, 264 bp, Homo sapien
  misc_feature (1)...(264): n = A,T,C or G
acattgtttttttgagataaagcattgagagagctctccttaacgtgacacaatggaaggactggaacacatacccacatctttgttctgagggataattttctgataaagtcttgctgtatattcaagcacatatgttatatattattcagttccatgtttatagcctagttaaggagaggggagatacattcngaaagaggactgaaagaaatactcaagtnggaaaacagaaaaagaaaaaaaggagcaaatgagaagcct

SEQ ID NO: 212 - DNA, 328 bp, Homo sapien
  misc_feature (1)...(328): n = A,T,C or G
acccaaaaatccaatgctgaatatttggcttcattattcccanattctttgattgtcaaaggatttaatgttgtctcagcttgggcacttcagttaggacctaaggatgccagccggcaggtttatatatgcagcaacaatattcaagcgcgacaacaggttattgaacttgcccgccagttnaatttcattcccattgacttgggatccttatcatcagccagagagattgaaaatttacccctacnactctttactctctgganagggccagtggtggtagctataagcttggccacatttttttttcctttattcctttgtcaga

SEQ ID NO: 213 - DNA, 250 bp, Homo sapien
  misc_feature (1)...(250): n = A,T,C or G
acttatgagcagagcgacatatccnagtgtagactgaataaaactgaattctctccagtttaaagcattgctcactgaagggatagaagtgactgccaggagggaaagtaagccaaggctcattatgccaaagganatatacatttcaattctccaaacttcttcctcattccaagagttttcaatatttgcatgaacctgctgataanccatgttaanaaacaaatatctctctnaccttctcatcggt

SEQ ID NO: 214 - DNA, 444 bp, Homo sapien
  misc_feature (1)...(444): n = A,T,C or G
acccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccanagagattgaaaatttacccctacgactctttactctctggagagggccagtggtggtagctataagcttggccacatttttttttcctttattcctttgtcagagatgcgattcatccatatgctanaaaccaacagagtgacttttacaaaattcctataganattgtgaataaaaccttacctatagttgccattactttgctctccctaatatacctc

SEQ ID NO: 215 - DNA, 366 bp, Homo sapien
  misc_feature (1)...(366): n = A,T,C or G
acttatgagcagagcgacatatccaagtgtanactgaataaaactgaattctctccagtttaaagcattgctcactgaagggatagaagtgactgccaggagggaaagtaagccaaggctcattatgccaaagganatatacatttcaattctccaaacttcttcctcattccaagagttttcaatatttgcatgaacctgctgataagccatgttgagaaacaaatatctctctgaccttctcatcggtaagcagaggctgtaggcaacatggaccatagcgaanaaaaaacttagtaatccaagctgttttctacactgtaaccaggtttccaaccaaggtggaaatctcctatacttggtgcc

SEQ ID NO: 216 - DNA, 260 bp, Homo sapien
  misc_feature (1)...(260): n = A,T,C or G
ctgtataaacagaactccactgcangagggagggccgggccaggagaatctccgcttgtccaagacaggggcctaaggagggtctccacactgctnntaagggctnttncatttttttattaataaaaagtnnaaaaggcctcttctcaacttttttcccttnggctggaaaatttaaaaatcaaaaatttcctnaagttntcaagctatcatatatactntatcctgaaaaagcaacataattcttccttccctccttt

SEQ ID NO: 217 - DNA, 262 bp, Homo sapien
  misc_feature (1)...(262): n = A,T,C or G
acctacgtgggtaagtttanaaatgttataatttcaggaanaggaacgcatataattgtatcttgcctataattttctattttaataaggaaatagcaaattggggtggggggaatgtagggcattctacagtttgagcaaaatgcaattaaatgtggaaggacagcactgaaaaattttatgaataatctgtatgattatatgtctctagagtagatttataattagccacttaccctaatatccttcatgcttgtaaagt

SEQ ID NO: 218 - DNA, 205 bp, Homo sapien
  misc_feature (1)...(205): n = A,T,C or G
accaaggtggtgcattaccggaantggatcaangacaccatcgtggccaacccctgagcacccctatcaactcccttttgtagtaaacttggaaccttggaaatgaccaggccaagactcaggcctccccagttctactgacctttgtccttangtntnangtccagggttgctaggaaaanaaatcagcagacacaggtgtaaa

SEQ ID NO: 219 - DNA, 114 bp, Homo sapien
tactgttttgtctcagtaacaataaatacaaaaagactggttgtgttccggccccatccaaccacgaagttgatttctcttgtgtgcagagtgactgattttaaaggacatgga

SEQ ID NO: 220 - DNA, 93 bp, Homo sapien
actagccagcacaaaaggcagggtagcctgaattgctttctgctctttacatttcttttaaaataagcatttagtgctcagtccctactgagt

SEQ ID NO: 221 - DNA, 167 bp, Homo sapien
  misc_feature (1)...(167): n = A,T,C or G
actangtgcaggtgcgcacaaatatttgtcgatattcccttcatcttggattccatgaggtcttttgcccagcctgtggctctactgtagtaagtttctgctgatgaggagccagnatgccccccactaccttccctgacgctccccanaaatcacccaacctctgt

SEQ ID NO: 222 - DNA, 351 bp, Homo sapien
agggcgtggtgcggagggcggtactgacctcattagtaggaggatgcattctggcaccccgttcttcacctgtcccccaatccttaaaaggccatactgcataaagtcaacaacagataaatgtttgctgaattaaaggatggatgaaaaaaattaataatgaatttttgcataatccaattttctcttttatatttctagaagaagtttctttgagcctattagatcccgggaatcttttaggtgagcatgattagagagcttgtaggttgcttttacatatatctggcatatttgagtctcgtatcaaaacaatagattggtaaaggtggtattattgtattgataagt

SEQ ID NO: 223 - DNA, 383 bp, Homo sapien
  misc_feature (1)...(383): n = A,T,C or G
aaaacaaacaaacaaaaaaaacaattcttcattcagaaaaattatcttagggactgatattggtaattatggtcaatttaatwrtrttktggggcatttccttacattgtcttgacaagattaaaatgtctgtgccaaaattttgtattttatttggagacttcttatcaaaagtaatgctgccaaaggaagtctaaggaattagtagtgttcccmtcacttgtttggagtgtgctattctaaaagattttgatttcctggaatgacaattatattttaactttggtgggggaaanagttataggaccacagtcttcacttctgatacttgtaaattaatcttttattgcacttgttttgaccattaagctatatgtttaaaa

SEQ ID NO: 224 - DNA, 320 bp, Homo sapien
cccctgaaggcttcttgttagaaaatagtacagttacaaccaataggaacaacaaaaagaaaaagtttgtgacattgtagtagggagtgtgtaccccttactccccatcaaaaaaaaaatggatacatggttaaaggataraagggcaatattttatcatatgttctaaaagagaaggaagagaaaatactactttctcraaatggaagcccttaaaggtgctttgatactgaaggacacaaatgtggccgtccatcctcctttaragttgcatgacttggacacggtaactgttgcagttttaractcmgcattgtgac

SEQ ID NO: 225 - DNA, 1214 bp, Homo sapien
gaggactgcagcccgcactcgcagccctggcaggcggcactggtcatggaaaacgaattgttctgctcgggcgtcctggtgcatccgcagtgggtgctgtcagccgcacactgtttccagaactcctacaccatcgggctgggcctgcacagtcttgaggccgaccaagagccagggagccagatggtggaggccagcctctccgtacggcacccagagtacaacagacccttgctcgctaacgacctcatgctcatcaagttggacgaatccgtgtccgagtctgacaccatccggagcatcagcattgcttcgcagtgccctaccgcggggaactcttgcctcgtttctggctggggtctgctggcgaacggcagaatgcctaccgtgctgcagtgcgtgaacgtgtcggtggtgtctgaggaggtctgcagtaagctctatgacccgctgtaccaccccagcatgttctgcgccggcggagggcaagaccagaaggactcctgcaacggtgactctggggggcccctgatctgcaacgggtacttgcagggccttgtgtctttcggaaaagccccgtgtggccaagttggcgtgccaggtgtctacaccaacctctgcaaattcactgagtggatagagaaaaccgtccaggccagttaactctggggactgggaacccatgaaattgacccccaaatacatcctgcggaaggaattcaggaatatctgttcccagcccctcctccctcaggcccaggagtccaggcccccagcccctcctccctcaaaccaagggtacagatccccagcccctcctccctcagacccaggagtccagaccccccagcccctcctccctcagacccaggagtccagcccctcctccctcagacccaggagtccagaccccccagcccctcctccctcagacccaggggtccaggcccccaacccctcctccctcagactcagaggtccaagcccccaacccctccttccccagacccagaggtccaggtcccagcccctcctccctcagacccagcggtccaatgccacctagactctccctgtacacagtgcccccttgtggcacgttgacccaaccttaccagttggtttttcattttttgtccctttcccctagatccagaaataaagtctaagagaagcgcaaaaaaaaaaaaaaaaaaaaaaaaaaaaaaaaaaaa

SEQ ID NO: 226 - DNA, 119 bp, Homo sapien
acccagtatgtgcagggagacggaaccccatgtgacagcccactccaccagggttcccaaagaacctggcccagtcataatcattcatcctgacagtggcaataatcacgataaccagt

SEQ ID NO: 227 - DNA, 818 bp, Homo sapien
acaattcatagggacgaccaatgaggacagggaatgaacccggctctcccccagccctgatttttgctacatatggggtcccttttcattctttgcaaaaacactgggttttctgagaacacggacggttcttagcacaatttgtgaaatctgtgtaraaccgggctttgcaggggagataattttcctcctctggaggaaaggtggtgattgacaggcagggagacagtgacaaggctagagaaagccacgctcggccttctctgaaccaggatggaacggcagacccctgaaaacgaagcttgtccccttccaatcagccacttctgagaacccccatctaacttcctactggaaaagagggcctcctcaggagcagtccaagagttttcaaagataacgtgacaactaccatctagaggaaagggtgcaccctcagcagagaagccgagagcttaactctggtcgtttccagagacaacctgctggctgtcttgggatgcgcccagcctttgagaggccactaccccatgaacttctgccatccactggacatgaagctgaggacactgggcttcaacactgagttgtcatgagagggacaggctctgccctcaagccggctgagggcagcaaccactctcctcccctttctcacgcaaagccattcccacaaatccagaccataccatgaagcaacgagacccaaacagtttggctcaagaggatatgaggactgtctcagcctggctttgggctgacaccatgcacacacacaaggtccacttctaggttttcagcctagatgggagtcgtgt

SEQ ID NO: 228 - DNA, 744 bp, Homo sapien
actggagacactgttgaacttgatcaagacccagaccaccccaggtctccttcgtgggatgtcatgacgtttgacatacctttggaacgagcctcctccttggaagatggaagaccgtgttcgtggccgacctggcctctcctggcctgtttcttaagatgcggagtcacatttcaatggtaggaaaagtggcttcgtaaaatagaagagcagtcactgtggaactaccaaatggcgagatgctcggtgcacattggggtgctttgggataaaagatttatgagccaactattctctggcaccagattctaggccagtttgttccactgaagcttttcccacagcagtccacctctgcaggctggcagctgaatggcttgccggtggctctgtggcaagatcacactgagatcgatgggtgagaaggctaggatgcttgtctagtgttcttagctgtcacgttggctccttccaggttggccagacggtgttggccactcccttctaaaacacaggcgccctcctggtgacagtgacccgccgtggtatgccttggcccattccagcagtcccagttatgcatttcaagtttggggtttgttcttttcgttaatgttcctctgtgttgtcagctgtcttcatttcctgggctaagcagcattgggagatgtggaccagagatccactccttaagaaccagtggcgaaagacactttctttcttcactctgaagtagctggtggt

SEQ ID NO: 229 - DNA, 300 bp, Homo sapien
cgagtctgggttttgtctataaagtttgatccctccttttctcatccaaatcatgtgaaccattacacatcgaaataaaagaaaggtggcagacttgcccaacgccaggctgacatgtgctgcagggttgttgttttttaattattattgttagaaacgtcacccacagtccctgttaatttgtatgtgacagccaactctgagaaggtcctatttttccacctgcagaggatccagtctcactaggctcctccttgccctcacactggagtctccgccagtgtgggtgcccactgacat

SEQ ID NO: 230 - DNA, 301 bp, Homo sapien
cagcagaacaaatacaaatatgaagagtgcaaagatctcataaaatctatgctgaggaatgagcgacagttcaaggaggagaagcttgcagagcagctcaagcaagctgaggagctcaggcaatataaagtcctggttcacactcaggaacgagagctgacccagttaagggagaagttgcgggaagggagagatgcctccctctcattgaatgagcatctccaggccctcctcactccggatgaaccggacaagtcccaggggcaggacctccaagaaacagacctcggccgcgaccacg

SEQ ID NO: 231 - DNA, 301 bp, Homo sapien
gcaagcacgctggcaaatctctgtcaggtcagctccagagaagccattagtcattttagccaggaactccaagtccacatccttggcaactggggacttgcgcaggttagccttgaggatggcaacacgggacttctcatcaggaagtgggatgtagatgagctgatcaagacggccaggtctgaggatggcaggatcaatgatgtcaggccggttggtaccgccaatgatgaacacatttttttttgtggacatgccatccatttctgtcaggatctggttgatgactcggtcagcagcc

SEQ ID NO: 232 - DNA, 301 bp, Homo sapien
agtaggtatttcgtgagaagttcaacaccaaaactggaacatagttctccttcaagtgttggcgacagcggggcttcctgattctggaatataactttgtgtaaattaacagccacctatagaagagtccatctgctgtgaaggagagacagagaactctgggttccgtcgtcctgtccacgtgctgtaccaagtgctggtgccagcctgttacctgttctcactgaaaatctggctaatgctcttgtgtatcacttctgattctgacaatcaatcaatcaatggcctagagcactgactg

SEQ ID NO: 233 - DNA, 301 bp, Homo sapien
atgactgacttcccagtaaggctctctaaggggtaagtaggaggatccacaggatttgagatgctaaggccccagagatcgtttgatccaaccctcttattttcagaggggaaaatggggcctagaagttacagagcatctagctggtgcgctggcacccctggcctcacacagactcccgagtagctgggactacaggcacacagtcactgaagcaggccctgttagcaattctatgcgtacaaattaacatgagatgagtagagactttattgagaaagcaagagaaaatcctatcaac

SEQ ID NO: 234 - DNA, 301 bp, Homo sapien
aggtcctacacatcgagactcatccatgattgatatgaatttaaaaattacaagcaaagacattttattcatcatgatgctttcttttgtttcttcttttcgttttcttctttttctttttcaatttcagcaacatacttctcaatttcttcaggatttaaaatcttgagggattgatctcgcctcatgacagcaagttcaatgtttttgccacctgactgaaccacttccaggagtgccttgatcaccagcttaatggtcagatcatctgcttcaatggcttcgtcagtatagttcttct

SEQ ID NO: 235 - DNA, 283 bp, Homo sapien
tggggctgtgcatcaggcgggtttgagaaatattcaattctcagcagaagccagaatttgaattccctcatcttttagggaatcatttaccaggtttggagaggattcagacagctcaggtgctttcactaatgtctctgaacttctgtccctctttgttcatggatagtccaataaataatgttatctttgaactgatgctcataggagagaatataagaactctgagtgatatcaacattagggattcaaagaaatattagatttaagctcacactggtca

SEQ ID NO: 236 - DNA, 301 bp, Homo sapien
aggtcctccaccaactgcctgaagcacggttaaaattgggaagaagtatagtgcagcataaatacttttaaatcgatcagatttccctaacccacatgcaatcttcttcaccagaagaggtcggagcagcatcattaataccaagcagaatgcgtaatagataaatacaatggtatatagtgggtagacggcttcatgagtacagtgtactgtggtatcgtaatctggacttgggttgtaaagcatcgtgtaccagtcagaaagcatcaatactcgacatgaacgaatataaagaacacca

SEQ ID NO: 237 - DNA, 301 bp, Homo sapien
cagtggtagtggtggtggacgtggcgttggtcgtggtgccttttttggtgcccgtcacaaactcaatttttgttcgctcctttttggccttttccaatttgtccatctcaattttctgggccttggctaatgcctcatagtaggagtcctcagaccagccatggggatcaaacatatcctttgggtagttggtgccaagctcgtcaatggcacagaatggatcagcttctcgtaaatctagggttccgaaattctttcttcctttggataatgtagttcatatccattccctcctttatct

SEQ ID NO: 238 - DNA, 301 bp, Homo sapien
gggcaggtttttttttttttttttttgatggtgcagacccttgctttatttgtctgacttgttcacagttcagccccctgctcagaaaaccaacgggccagctaaggagaggaggaggcaccttgagacttccggagtcgaggctctccagggttccccagcccatcaatcattttctgcaccccctgcctgggaagcagctccctggggggtgggaatgggtgactagaagggatttcagtgtgggacccagggtctgttcttcacagtaggaggtggaagggatgactaatttctttat

SEQ ID NO: 239 - DNA, 239 bp, Homo sapien
ataagcagctagggaattctttatttagtaatgtcctaacataaaagttcacataactgcttctgtcaaaccatgatactgagctttgtgacaacccagaaataactaagagaaggcaaacataataccttagagatcaagaaacatttacacagttcaactgtttaaaaatagctcaacattcagccagtgagtagagtgtgaatgccagcatacacagtatacaggtccttcaggga

SEQ ID NO: 240 - DNA, 300 bp, Homo sapien
ggtcctaatgaagcagcagcttccacattttaacgcaggtttacggtgatactgtcctttgggatctgccctccagtggaaccttttaaggaagaagtgggcccaagctaagttccacatgctgggtgagccagatgacttctgttccctggtcactttcttcaatggggcgaatgggggctgccaggtttttaaaatcatgcttcatcttgaagcacacggtcacttcaccctcctcacgctgtgggtgtactttgatgaaaatacccactttgttggcctttctgaagctataatgtc

SEQ ID NO: 241 - DNA, 301 bp, Homo sapien
gaggtctggtgctgaggtctctgggctaggaagaggagttctgtggagctggaagccagacctctttggaggaaactccagcagctatgttggtgtctctgagggaatgcaacaaggctgctcctccatgtattggaaaactgcaaactggactcaactggaaggaagtgctgctgccagtgtgaagaaccagcctgaggtgacagaaacggaagcaaacaggaacagccagtcttttcttcctcctcctgtcatacggtctctctcaagcatcctttgttgtcaggggcctaaaagggag

SEQ ID NO: 242 - DNA, 301 bp, Homo sapien
ccgaggtcctgggatgcaaccaatcactctgtttcacgtgacttttatcaccatacaatttgtggcatttcctcattttctacattgtagaatcaagagtgtaaataaatgtatatcgatgtcttcaagaatatatcattcctttttcactagaacccattcaaaatataagtcaagaatcttaatatcaacaaatatatcaagcaaactggaaggcagaataactaccataatttagtataagtacccaaagttttataaatcaaaagccctaatgataaccatttttagaattcaatca

SEQ ID NO: 243 - DNA, 301 bp, Homo sapien
aggtaagtcccagtttgaagctcaaaagatctggtatgagcataggctcatcgacgacatggtggcccaagctatgaaatcagagggaggcttcatctgggcctgtaaaaactatgatggtgacgtgcagtcggactctgtggcccaagggtatggctctctcggcatgatgaccagcgtgctggtttgtccagatggcaagacagtagaagcagaggctgcccacgggactgtaacccgtcactaccgcatgttccagaaaggacaggagacgtccaccaatcccattgcttccattttt

SEQ ID NO: 244 - DNA, 300 bp, Homo sapien
gctggtttgcaagaatgaaatgaatgattctacagctaggacttaaccttgaaatggaaagtcatgcaatcccatttgcaggatctgtctgtgcacatgcctctgtagagagcagcattcccagggaccttggaaacagttgacactgtaaggtgcttgctccccaagacacatcctaaaaggtgttgtaatggtgaaaacgtcttccttctttattgccccttcttatttatgtgaacaactgtttgtcttttgtgtatcttttttaaactgtaaagttcaattgtgaaaatgaatatc

SEQ ID NO: 245 - DNA, 301 bp, Homo sapien
gtctgagtatttaaaatgttattgaaattatccccaaccaatgttagaaaagaaagaggttatatacttagataaaaaatgaggtgaattactatccattgaaatcatgctcttagaattaaggccaggagatattgtcattaatgtaracttcaggacactagagtatagcagccctatgttttcaaagagcagagatgcaattaaatattgtttagcatcaaaaaggccactcaatacagctaataaaatgaaagacctaatttctaaagcaattctttataatttacaaagttttaag

SEQ ID NO: 246 - DNA, 301 bp, Homo sapien
ggtctgtcctacaatgcctgcttcttgaaagaagtcggcactttctagaatagctaaataacctgggcttattttaaagaactatttgtagctcagattggttttcctatggctaaaataagtgcttcttgtgaaaattaaataaaacagttaattcaaagccttgatatatgttaccactaacaatcatactaaatatattttgaagtacaaagtttgacatgctctaaagtgacaacccaaatgtgtcttacaaaacacgttcctaacaaggtatgctttacactaccaatgcagaaac

SEQ ID NO: 247 - DNA, 301 bp, Homo sapien
aggtcctttggcagggctcatggatcagagctcaaactggagggaaaggcatttcgggtagcctaagagggcgactggcggcagcacaaccaaggaaggcaaggttgtttcccccacgctgtgtcctgtgttcaggtgcgacacacaatcctcatgggaacaggatcacccatgcgctgcccttgatgatcaaggttggggcttaagtggattaagggaggcaagttctgggttccttgccttttcaaaccatgaagtcaggctctgtatccctccttttcctaactgatattctaactaa

SEQ ID NO: 248 - DNA, 301 bp, Homo sapien
aggtccttggagatgccatttcagccgaaggactcttctwttcggaagtacaccctcactattaggaagattcttaggggtaatttttctgaggaaggagaactagccaacttaagaattacaggaagaaagtggtttggaagacagccaaagaaataaaagcagattaaattgtatcaggtacattccagcctgttggcaactccataaaaacatttcagattttaatcccgaatttagctaatgagactggatttttgttttttatgttgtgtgtcgcagagctaaaaactcagttccc

SEQ ID NO: 249 - DNA, 301 bp, Homo sapien
gtccagaggaagcacctggtgctgaactaggcttgccctgctgtgaacttgcacttggagccctgacgctgctgttctccccgaaaaacccgaccgacctccgcgatctccgtcccgcccccagggagacacagcagtgactcagagctggtcgcacactgtgcctccctcctcaccgcccatcgtaatgaattattttgaaaattaattccaccatcctttcagattctggatggaaagactgaatctttgactcagaattgtttgctgaaaagaatgatgtgactttcttagtcattta

SEQ ID NO: 250 - DNA, 301 bp, Homo sapien
ggtctgtgacaaggacttgcaggctgtgggaggcaagtgacccttaacactacacttctccttatctttattggcttgataaacataattatttctaacactagcttatttccagttgcccataagcacatcagtacttttctctggctggaatagtaaactaaagtatggtacatctacctaaaagactactatgtggaataatacatactaatgaagtattacatgatttaaagactacaataaaaccaaacatgcttataacattaagaaaaacaataaagatacatgattgaaacca

SEQ ID NO: 251 - DNA, 301 bp, Homo sapien
gccgaggtcctacatttggcccagtttccccctgcatcctctccagggcccctgcctcatagacaacctcatagagcataggagaactggttgccctgggggcagggggactgtctggatggcaggggtcctcaaaaatgccactgtcactgccaggaaatgcttctgagcagtacacctcattgggatcaatgaaaagcttcaagaaatcttcaggctcactctcttgaaggcccggaacctctggaggggggcagtggaatcccagctccaggacggatcctgtcgaaaagatatcctc

SEQ ID NO: 252 - DNA, 301 bp, Homo sapien
gcaaccaatcactctgtttcacgtgacttttatcaccatacaatttgtggcatttcctcattttctacattgtagaatcaagagtgtaaataaatgtatatcgatgtcttcaagaatatatcattcctttttcactaggaacccattcaaaatataagtcaagaatcttaatatcaacaaatatatcaagcaaactggaaggcagaataactaccataatttagtataagtacccaaagttttataaatcaaaagccctaatgataaccatttttagaattcaatcatcactgtagaatca

SEQ ID NO: 253 - DNA, 301 bp, Homo sapien
ttccctaagaagatgttattttgttgggttttgttccccctccatctcgattctcgtacccaactaaaaaaaaaaaataaagaaaaaatgtgctgcgttctgaaaaataactccttagcttggtctgattgttttcagaccttaaaatataaacttgtttcacaagctttaatccatgtggattttttttcttagagaaccacaaaacataaaaggagcaagtcggactgaatacctgtttccatagtgcccacagggtattcctcacattttctccataggaaaatgctttttcccaagg

SEQ ID NO: 254 - DNA, 301 bp, Homo sapien
cgctgcgcctttcccttgggggaggggcaaggccagagggggtccaagtgcagcacgaggaacttgaccaattcccttgaagcgggtgggttaaaccctgtaaatgggaacaaaatccccccaaatctcttcatcttaccctggtggactcctgactgtagaattttttggttgaaacaagaaaaaaataaagctttggacttttcaaggttgcttaacaggtactgaaagactggcctcacttaaactgagccaggaaaagctgcagatttattaatgggtgtgttagtgtgcagtgcct

SEQ ID NO: 255 - DNA, 302 bp, Homo sapien
agctttttttttttttttttttttttttttttcattaaaaaatagtgctctttattataaattactgaaatgtttcttttctgaatataaatataaatatgtgcaaagtttgacttggattgggattttgttgagttcttcaagcatctcctaataccctcaagggcctgagtaggggggaggaaaaaggactggaggtggaatctttataaaaaacaagagtgattgaggcagattgtaaacattattaaaaaacaagaaacaaacaaaaaaatagagaaaaaaaccaccccaacacacaa

SEQ ID NO: 256 - DNA, 301 bp, Homo sapien
  misc_feature (1)...(301): n = A,T,C or G
gttccagaaaacattgaaggtggcttcccaaagtctaactagggataccccctctagcctaggaccctcctccccacacctcaatccaccaaaccatccataatgcacccagataggcccacccccaaaagcctggacaccttgagcacacagttatgaccaggacagactcatctctataggcaaatagctgctggcaaactggcattacctggtttgtggggatgggggggcaagtgtgtggcctctcggcctggttagcaagaacattcagggtaggcctaagttantcgtgttagtt

SEQ ID NO: 257 - DNA, 301 bp, Homo sapien
gttgtggaggaactctggcttgctcattaagtcctactgattttcactatcccctgaatttccccacttatttttgtctttcactatcgcaggccttagaagaggtctacctgcctccagtcttacctagtccagtctaccccctggagttagaatggccatcctgaagtgaaaagtaatgtcacattactcccttcagtgatttcttgtagaagtgccaatccctgaatgccaccaagatcttaatcttcacatctttaatcttatctctttgactcctctttacaccggagaaggctcc

SEQ ID NO: 258 - DNA, 301 bp, Homo sapien
  misc_feature (1)...(301): n = A,T,C or G
cagcagtagtagatgccgtatgccagcacgcccagcactcccaggatcagcaccagcaccaggggcccagccaccaggcgcagaagcaagataaacagtaggctcaagaccagagccacccccagggcaacaagaatccaataccaggactgggcaaaatcttcaaagatcttaacactgatgtctcgggcattgaggctgtcaataanacgctgatcccctgctgtatggtggtgtcattggtgatccctgggagcgccggtggagtaacgttggtccatggaaagcagcgcccacaact

SEQ ID NO: 259 - DNA, 301 bp, Homo sapien
  misc_feature (1)...(301): n = A,T,C or G
tcatatatgcaaacaaatgcagactangcctcaggcagagactaaaggacatctcttggggtgtcctgaagtgatttggacccctgagggcagacacctaagtaggaatcccagtgggaagcaaagccataaggaagcccaggattccttgtgatcaggaagtgggccaggaaggtctgttccagctcacatctcatctgcatgcagcacggaccggatgcgcccactgggtcttggcttccctcccatcttctcaagcagtgtccttgttgagccatttgcatccttggctccaggtggc

SEQ ID NO: 260 - DNA, 301 bp, Homo sapien
ttttttttctccctaaggaaaaagaaggaacaagtctcataaaaccaaataagcaatggtaaggtgtcttaacttgaaaaagattaggagtcactggtttacaagttataattgaatgaaagaactgtaacagccacagttggccatttcatgccaatggcagcaaacaacaggattaactagggcaaaataaataagtgtgtggaagccctgataagtgcttaataaacagactgattcactgagacatcagtacctgcccgggcggccgctcgagccgaattctgcagatatccatcac

SEQ ID NO: 261 - DNA, 301 bp, Homo sapien
aaatattcgagcaaatcctgtaactaatgtgtctccataaaaggctttgaactcagtgaatctgcttccatccacgattctagcaatgacctctcggacatcaaagctcctcttaaggttagcaccaactattccatacaattcatcagcaggaaataaaggctcttcagaaggttcaatggtgacatccaatttcttctgataatttagattcctcacaaccttcctagttaagtgaagggcatgatgatcatccaaagcccagtggtcacttactccagactttctgcaatgaagatca

SEQ ID NO: 262 - DNA, 301 bp, Homo sapien
gaggagagcctgttacagcatttgtaagcacagaatactccaggagtatttgtaattgtctgtgagcttcttgccgcaagtctctcagaaatttaaaaagatgcaaatccctgagtcacccctagacttcctaaaccagatcctctggggctggaacctggcactctgcatttgtaatgagggctttctggtgcacacctaattttgtgcatctttgccctaaatcctggattagtgccccatcattacccccacattataatgggatagattcagagcagatactctccagcaaagaatc

SEQ ID NO: 263 - DNA, 301 bp, Homo sapien
  misc_feature (1)...(301): n = A,T,C or G
tttagcttgtggtaaatgactcacaaaactgattttaaaatcaagttaatgtgaattttgaaaattactacttaatcctaattcacaataacaatggcattaaggtttgacttgagttggttcttagtattatttatggtaaataggctcttaccacttgcaaataactggccacatcattaatgactgacttcccagtaaggctctctaaggggtaagtangaggatccacaggatttgagatgctaaggccccagagatcgtttgatccaaccctcttattttcagaggggaaaatggg

SEQ ID NO: 264 - DNA, 301 bp, Homo sapien
aaagacgttaaaccactctactaccacttgtggaactctcaaagggtaaatgacaaasccaatgaatgactctaaaaacaatatttacatttaatggtttgtagacaataaaaaaacaaggtggatagatctagaattgtaacattttaagaaaaccatascatttgacagatgagaaagctcaattatagatgcaaagttataactaaactactatagtagtaaagaaatacatttcacacccttcatataaattcactatcttggcttgaggcactccataaaatgtatcacgtgcata

SEQ ID NO: 265 - DNA, 301 bp, Homo sapien
tgcccaagttatgtgtaagtgtatccgcacccagaggtaaaactacactgtcatctttgtcttcttgtgacgcagtatttcttctctggggagaagccgggaagtcttctcctggctctacatattcttggaagtctctaatcaacttttgttccatttgtttcatttcttcaggagggattttcagtttgtcaacatgttctctaacaacacttgcccatttctgtaaagaatccaaagcagtccaaggctttgacatgtcaacaaccagcataactagagtatccttcagagatacggc

SEQ ID NO: 266 - DNA, 301 bp, Homo sapien
taccgtctgcccttcctcccatccaggccatctgcgaatctacatgggtcctcctattcgacaccagatcactctttcctctacccacaggcttgctatgagcaagagacacaacctcctctcttctgtgttccagcttcttttcctgttcttcccaccccttaagttctattcctggggatagagacaccaatacccataacctctctcctaagcctccttataacccagggtgcacagcacagactcctgacaactggtaaggccaatgaactgggagctcacagctggctgtgcctga

SEQ ID NO: 267 - DNA, 301 bp, Homo sapien
aaagagcacaggccagctcagcctgccctggccatctagactcagcctggctccatgggggttctcagtgctgagtccatccaggaaaagctcacctagaccttctgaggctgaatcttcatcctcacaggcagcttctgagagcctgatattcctagccttgatggtctggagtaaagcctcattctgattcctctccttcttttctttcaagttggctttcctcacatccctctgttcaattcgcttcagcttgtctgctttagccctcatttccagaagcttcttctctttggcatct

SEQ ID NO: 268 - DNA, 301 bp, Homo sapien
aatgtctcactcaactacttcccagcctaccgtggcctaattctgggagttttcttcttagatcttgggagagctggttcttctaaggagaaggaggaaggacagatgtaactttggatctcgaagaggaagtctaatggaagtaattagtcaacggtccttgtttagactcttggaatatgctgggtggctcagtgagcccttttggagaaagcaagtattattcttaaggagtaaccacttcccattgttctactttctaccatcatcaattgtatattatgtattctttggagaacta

SEQ ID NO: 269 - DNA, 301 bp, Homo sapien
taacaatatacactagctatctttttaactgtccatcattagcaccaatgaagattcaataaaattacctttattcacacatctcaaaacaattctgcaaattcttagtgaagtttaactatagtcacagaccttaaatattcacattgttttctatgtctactgaaaataagttcactacttttctggatattctttacaaaatcttattaaaattcctggtattatcacccccaattatacagtagcacaaccaccttatgtagtttttacatgatagctctgtagaagtttcacatct

SEQ ID NO: 270 - DNA, 301 bp, Homo sapien
cattgaagagcttttgcgaaacatcagaacacaagtgcttataaaattaattaagccttacacaagaatacatattccttttatttctaaggagttaaacatagatgtagctgatgtggagagcttgctggtgcagtgcatattggataacactattcatggccgaattgatcaagtcaaccaactccttgaactggatcatcagaagaagggtggtgcacgatatactgcactagataatggaccaaccaactaaattctctcaccaggctgtatcagtaaactggcttaacagaaaaca

SEQ ID NO: 271 - DNA, 301 bp, Homo sapien
  misc_feature (1)...(301): n = A,T,C or G
aaaaggttctcataagattaacaatttaaataaatatttgatagaacattctttctcatttttatagctcatctttagggttgatattcagttcatgcttcccttgctgttcttgatccagaattgcaatcacttcatcagcctgtattcgctccaattctctataaagtgggtccaaggtgaaccacagagccacagcacacctctttcccttggtgactgccttcaccccatganggttctctcctccagatganaactgatcatgcgcccacattttgggttttatagaagcagtcac

SEQ ID NO: 272 - DNA, 301 bp, Homo sapien
taaattgctaagccacagataacaccaatcaaatggaacaaatcactgtcttcaaatgtcttatcagaaaaccaaatgagcctggaatcttcataatacctaaacatgccgtatttaggatccaataattccctcatgatgagcaagaaaaattctttgcgcacccctcctgcatccacagcatcttctccaacaaatataaccttgagtggcttcttgtaatctatgttctttgttttcctaaggacttccattgcatctcctacaatattttctctacgcaccactagaattaagcagg

SEQ ID NO: 273 - DNA, 301 bp, Homo sapien
  misc_feature (1)...(301): n = A,T,C or G
acatgtgtgtatgtgtatctttgggaaaanaanaagacatcttgtttaytatttttttggagagangctgggacatggataatcacwtaatttgctaytatyactttaatctgactygaagaaccgtctaaaaataaaatttaccatgtcdtatattccttatagtatgcttatttcaccttytttctgtccagagagagtatcagtgacananatttmagggtgaamacatgmattggtgggacttntytttacngagmaccctgcccgsgcgccctcgmakcnganttccgcsananct

SEQ ID NO: 274 - DNA, 301 bp, Homo sapien
  misc_feature (1)...(301): n = A,T,C or G
cttatatactctttctcagaggcaaaagaggagatgggtaatgtagacaattctttgaggaacagtaaatgattattagagagaangaatggaccaaggagacagaaattaacttgtaaatgattctctttggaatctgaatgagatcaagaggccagctttagcttgtggaaaagtccatctaggtatggttgcattctcgtcttcttttctgcagtagataatgaggtaaccgaaggcaattgtgcttcttttgataagaagctttcttggtcatatcaggaaattccaganaaagtcc

SEQ ID NO: 275 - DNA, 301 bp, Homo sapien
  misc_feature (1)...(301): n = A,T,C or G
tcggtgtcagcagcacgtggcattgaacattgcaatgtggagcccaaaccacagaaaatggggtgaaattggccaactttctattaacttatgttggcaattttgccaccaacagtaagctggcccttctaataaaagaaaattgaaaggtttctcactaaacggaattaagtagtggagtcaagagactcccaggcctcagcgtacctgcccgggcggccgctcgaagccgaattctgcagatatccatcacactggcggncgctcgancatgcatctagaaggnccaattcgccctata

SEQ ID NO: 276 - DNA, 301 bp, Homo sapien
tgtacacatactcaataaataaatgactgcattgtggtattattactatactgattatatttatcatgtgacttctaattagaaaatgtatccaaaagcaaaacagcagatatacaaaattaaagagacagaagatagacattaacagataaggcaacttatacattgagaatccaaatccaatacatttaaacatttgggaaatgagggggacaaatggaagccagatcaaatttgtgtaaaactattcagtatgtttcccttgcttcatgtctgagaaggctctccttcaatggggatg

SEQ ID NO: 277 - DNA, 301 bp, Homo sapien
  misc_feature (1)...(301): n = A,T,C or G
tttgttgatgtcagtattttattacttgcgttatgagtgctcacctgggaaattctaaagatacagaggacttggaggaagcagagcaactgaatttaatttaaaagaaggaaaacattggaatcatggcactcctgatactttcccaaatcaacactctcaatgccccaccctcgtcctcaccatagtggggagactaaagtggccacggatttgccttangtgtgcagtgcgttctgagttcnctgtcgattacatctgaccagtctcctttttccgaagtccntccgttcaatcttgc

SEQ ID NO: 278 - DNA, 301 bp, Homo sapien
  misc_feature (1)...(301): n = A,T,C or G
taccactacactccagcctgggcaacagagcaagacctgtctcaaagcataaaatggaataacatatcaaatgaaacagggaaaatgaagctgacaatttatggaagccagggcttgtcacagtctctactgttattatgcattacctgggaatttatataagcccttaataataatgccaatgaacatctcatgtgtgctcacaatgttctggcactattataagtgcttcacaggttttatgtgttcttcgtaactttatggantaggtactcggccgcgaacacgctaagccgaattc

SEQ ID NO: 279 - DNA, 301 bp, Homo sapien
  misc_feature (1)...(301): n = A,T,C or G
aaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaanaanaaatatttctagggagcactaccatctgttttcacatgaaatgccacacacatagaactccaacatcaatttcattgcacaga

SEQ ID NO: 280 - DNA, 301 bp, Homo sapien
ggtactggagttttcctcccctgtgaaaacgtaactactgttgggagtgaattgaggatgtagaaaggtggtggaaccaaattgtggtcaatggaaataggagaatatggttctcactcttgagaaaaaaacctaagattagcccaggtagttgcctgtaacttcagtttttctgcctgggtttgatatagtttagggttggggttagattaagatctaaattacatcaggacaaagagacagactattaactccacagttaattaaggaggtatgttccatgtttatttgttaaagcagt

SEQ ID NO: 281 - DNA, 301 bp, Homo sapien
aggtacaagaaggggaatgggaaagagctgctgctgtggcattgttcaacttggatattcgccgagcaatccaaatcctgaatgaaggggcatcttctgaaaaaggagatctgaatctcaatgtggtagcaatggctttatcgggttatacggatgagaagaactccctttggagagaaatgtgtagcacactgcgattacagctaaataacccgtatttgtgtgtcatgtttgcatttctgacaagtgaaacaggatcttacgatggagttttgtatgaaaacaaagttgcagtacctcg

SEQ ID NO: 282 - DNA, 301 bp, Homo sapien
caggtactacagaattaaaatactgacaagcaagtagtttcttggcgtgcacgaattgcatccagaacccaaaaattaagaaattcaaaaagacattttgtgggcacctgctagcacagaagcgcagaagcaaagcccaggcagaaccatgctaaccttacagctcagcctgcacagaagcgcagaagcaaagcccaggcagaaccatgctaaccttacagctcagcctgcacagaagcgcagaagcaaagcccaggcagaacatgctaaccttacagctcagcctgcacagaagcacaga

SEQ ID NO: 283 - DNA, 301 bp, Homo sapien
atctgtatacggcagacaaactttataragtgtagagaggtgagcgaaaggatgcaaaagcactttgagggctttataataatatgctgcttgaaaaaaaaaatgtgtagttgatactcagtgcatctccagacatagtaaggggttgctctgaccaatcaggtgatcattttttctatcacttcccaggttttatgcaaaaattttgttaaattctataatggtgatatgcatcttttaggaaacatatacatttttaaaaatctattttatgtaagaactgacagacgaatttgctttg

SEQ ID NO: 284 - DNA, 301 bp, Homo sapien
caggtacaaaacgctattaagtggcttagaatttgaacatttgtggtctttatttactttgcttcgtgtgtgggcaaagcaacatcttccctaaatatatattaccaagaaaagcaagaagcagattaggtttttgacaaaacaaacaggccaaaagggggctgacctggagcagagcatggtgagaggcaaggcatgagagggcaagtttgttgtggacagatctgtgcctactttattactggagtaaaagaaaacaaagttcattgatgtcgaaggatatatacagtgttagaaatta

SEQ ID NO: 285 - DNA, 301 bp, Homo sapien
  misc_feature (1)...(301): n = A,T,C or G
acatcaccatgatcggatcccccacccattatacgttgtatgtttacataaatactcttcaatgatcattagtgttttaaaaaaaatactgaaaactccttctgcatcccaatctctaaccaggaaagcaaatgctatttacagacctgcaagccctccctcaaacnaaactatttctggattaaatatgtctgacttcttttgaggtcacacgactaggcaaatgctatttacgatctgcaaaagctgtttgaagagtcaaagcccccatgtgaacacgatttctggaccctgtaacagt

SEQ ID NO: 286 - DNA, 301 bp, Homo sapien
taccactgcattccagcctgggtgacagagtgagactccgtctccaaaaaaaactttgcttgtatattatttttgccttacagtggatcattctagtaggaaaggacagtaagattttttatcaaaatgtgtcatgccagtaagagatgttatattcttttctcatttcttccccacccaaaaataagctaccatatagcttataagtctcaaatttttgccttttactaaaatgtgattgtttctgttcattgtgtatgcttcatcacctatattaggcaaattccattttttcccttgt

SEQ ID NO: 287 - DNA, 301 bp, Homo sapien
tacagatctgggaactaaatattaaaaatgagtgtggctggatatatggagaatgttgggcccagaaggaacgtagagatcagatattacaacagctttgttttgagggttagaaatatgaaatgatttggttatgaacgcacagtttaggcagcagggccagaatcctgaccctctgccccgtggttatctcctccccagcttggctgcctcatgttatcacagtattccattttgtttgttgcatgtcttgtgaagccatcaagattttctcgtctgttttcctctcattggtaatgct

SEQ ID NO: 288 - DNA, 301 bp, Homo sapien
gtacacctaactgcaaggacagctgaggaatgtaatgggcagccgcttttaaagaagtagagtcaataggaagacaaattccagttccagctcagtctgggtatctgcaaagctgcaaaagatctttaaagacaatttcaagagaatatttccttaaagttggcaatttggagatcatacaaaagcatctgcttttgtgatttaatttagctcatctggccactggaagaatccaaacagtctgccttaattttggatgaatgcatgatggaaattcaataatttagaaagttaaaaaaaa

SEQ ID NO: 289 - DNA, 301 bp, Homo sapien
  misc_feature (1)...(301): n = A,T,C or G
ggtacactgtttccatgttatgtttctacacattgctacctcagtgctcctggaaacttagcttttgatgtctccaagtagtccaccttcatttaactctttgaaactgtatcatctttgccaagtaagagtggtggcctatttcagctgctttgacaaaatgactggctcctgacttaacgttctataaatgaatgtgctgaagcaaagtgcccatggtggcggcgaanaagagaaagatgtgttttgttttggactctctgtggtcccttccaatgctgtgggtttccaaccagnggaa

SEQ ID NO: 290 - DNA, 301 bp, Homo sapien
  misc_feature (1)...(301): n = A,T,C or G
acactgagctcttcttgataaatatacagaatgcttggcatatacaagattctatactactgactgatctgttcatttctctcacagctcttacccccaaaagcttttccaccctaagtgttctgacctccttttctaatcacagtagggatagaggcaganccacctacaatgaacatggagttctatcaagaggcagaaacagcacagaatcccagttttaccattcgctagcagtgctgccttgaacaaaaacatttctccatgtctcattttcttcatgcctcaagtaacagtgaga

SEQ ID NO: 291 - DNA, 301 bp, Homo sapien
caggtaccaatttcttctatcctagaaacatttcattttatgttgttgaaacataacaactatatcagctagattttttttctatgctttacctgctatggaaaatttgacacattctgctttactcttttgtttataggtgaatcacaaaatgtatttttatgtattctgtagttcaatagccatggctgtttacttcatttaatttatttagcataaagacattatgaaaaggcctaaacatgagcttcacttccccactaactaattagcatctgttatttcttaaccgtaatgccta

SEQ ID NO: 292 - DNA, 301 bp, Homo sapien
  misc_feature (1)...(301): n = A,T,C or G
accttttagtagtaatgtctaataataaataagaaatcaattttataaggtccatatagctgtattaaataatttttaagtttaaaagataaaataccatcattttaaatgttggtattcaaaaccaaagnatataaccgaaaggaaaaacagatgagacataaaatgatttgcnagatgggaaatatagtasttyatgaatgttnattaaattccagttataatagtggctacacactctcactacacacacagaccccacagtcctatatgccacaaacacatttccataacttgaaaa

SEQ ID NO: 293 - DNA, 301 bp, Homo sapien
ggtaccaagtgctggtgccagcctgttacctgttctcactgaaaagtctggctaatgctcttgtgtagtcacttctgattctgacaatcaatcaatcaatggcctagagcactgactgttaacacaaacgtcactagcaaagtagcaacagctttaagtctaaatacaaagctgttctgtgtgagaattttttaaaaggctacttgtataataacccttgtcatttttaatgtacctcggccgcgaccacgctaagccgaattctgcagatatccatcacactggcggccgctcgagcatg

SEQ ID NO: 294 - DNA, 301 bp, Homo sapien
  misc_feature (1)...(301): n = A,T,C or G
tgacccataacaatatacactagctatctttttaactgtccatcattagcaccaatgaagattcaataaaattacctttattcacacatctcaaaacaattctgcaaattcttagtgaagtttaactatagtcacagancttaaatattcacattgttttctatgtctactgaaaataagttcactacttttctgggatattctttacaaaatcttattaaaattcctggtattatcacccccaattatacagtagcacaaccaccttatgtagtttttacatgatagctctgtagaggtt

SEQ ID NO: 295 - DNA, 305 bp, Homo sapien
gtactctttctctcccctcctctgaatttaattctttcaacttgcaatttgcaaggattacacatttcactgtgatgtatattgtgttgcaaaaaaaaaagtgtctttgtttaaaattacttggtttgtgaatccatcttgctttttccccattggaactagtcattaacccatctctgaactggtagaaaaacrtctgaagagctagtctatcagcatctgacaggtgaattggatggttctcagaaccatttcacccagacagcctgtttctatcctgtttaataaattagtttgggttctct

SEQ ID NO: 296 - DNA, 301 bp, Homo sapien
aggtactatgggaagctgctaaaataatatttgatagtaaaagtatgtaatgtgctatctcacctagtagtaaactaaaaataaactgaaactttatggaatctgaagttattttccttgattaaatagaattaataaaccaatatgaggaaacatgaaaccatgcaatctactatcaactttgaaaaagtgattgaacgaaccacttagctttcagatgatgaacactgataagtcatttgtcattactataaattttaaaatctgttaataagatggcctatagggaggaaaaaggggc

SEQ ID NO: 297 - DNA, 300 bp, Homo sapien
  misc_feature (1)...(300): n = A,T,C or G
actgagttttaactggacgccaagcaggcaaggctggaaggttttgctctctttgtgctaaaggttttgaaaaccttgaaggagaatcattttgacaagaagtacttaagagtctagagaacaaagangtgaaccagctgaaagctctcgggggaancttacatgtgttgttaggcctgttccatcattgggagtgcactggccatccctcaaaatttgtctgggctggcctgagtggtcaccgcacctcggccgcgaccacgctaagccgaattctgcagatatccatcacactggcgg

SEQ ID NO: 298 - DNA, 301 bp, Homo sapien
  misc_feature (1)...(301): n = A,T,C or G
tatggggtttgtcacccaaaagctgatgctgagaaaggcctccctggggcccctcccgcgggcatctgagagacctggtgttccagtgtttctggaaatgggtcccagtgccgccggctgtgaagctctcagatcaatcacgggaagggcctggcggtggtggccacctggaaccaccctgtcctgtctgtttacatttcactaycaggttttctctgggcattacnatttgttcccctacaacagtgacctgtgcattctgctgtggcctgctgtgtctgcaggtggctctcagcgaggt

SEQ ID NO: 299 - DNA, 301 bp, Homo sapien
gttttgagacggagtttcactcttgttgcccagactggactgcaatggcagggtctctgctcactgcaccctctgcctcccaggttcgagcaattctcctgcctcagcctcccaggtagctgggattgcaggctcacgccaccatacccagctaatttttttgtatttttagtagagacggagtttcgccatgttggccagctggtctcaaactcctgacctcaagcgacctgcctgcctcggcctcccaaagtgctggaattataggcatgagtcaacacgcccagcctaaagatatttt

SEQ ID NO: 300 - DNA, 301 bp, Homo sapien
attcagttttatttgctgccccagtatctgtaaccaggagtgccacaaaatcttgccagatatgtcccacacccactgggaaaggctcccacctggctacttcctctatcagctgggtcagctgcattccacaaggttctcagcctaatgagtttcactacctgccagtctcaaaacttagtaaagcaagaccatgacattcccccacggaaatcagagtttgccccaccgtcttgttactataaagcctgcctctaacagtccttgcttcttcacaccaatcccgagcgcatcccccatg

SEQ ID NO: 301 - DNA, 301 bp, Homo sapien
ttaaatttttgagaggataaaaaggacaaataatctagaaatgtgtcttcttcagtctgcagaggaccccaggtctccaagcaaccacatggtcaagggcatgaataattaaaagttggtgggaactcacaaagaccctcagagctgagacacccacaacagtgggagctcacaaagaccctcagagctgagacacccacaacagtgggagctcacaaagaccctcagagctgagacacccacaacagcacctcgttcagctgccacatgtgtgaataaggatgcaatgtccagaagtgtt

SEQ ID NO: 302 - DNA, 301 bp, Homo sapien
aggtacacatttagcttgtggtaaatgactcacaaaactgattttaaaatcaagttaatgtgaattttgaaaattactacttaatcctaattcacaataacaatggcattaaggtttgacttgagttggttcttagtattatttatggtaaataggctcttaccacttgcaaataactggccacatcattaatgactgacttcccagtaaggctctctaaggggtaagtaggaggatccacaggatttgagatgctaaggccccagagatcgtttgatccaaccctcttattttcagaggg

SEQ ID NO: 303 - DNA, 301 bp, Homo sapien
aggtaccaactgtggaaataggtagaggatcattttttctttccatatcaactaagttgtatattgttttttgacagtttaacacatcttcttctgtcagagattctttcacaatagcactggctaatggaactaccgcttgcatgttaaaaatggtggtttgtgaaatgatcataggccagtaacgggtatgtttttctaactgatcttttgctcgttccaaagggacctcaagacttccatcgattttatatctggggtctagaaaaggagttaatctgttttccctcataaattcacc

SEQ ID NO: 304 - DNA, 301 bp, Homo sapien
acatggatgttattttgcagactgtcaacctgaatttgtatttgcttgacattgcctaattattagtttcagtttcagcttacccactttttgtctgcaacatgcaraasagacagtgccctttttagtgtatcatatcaggaatcatctcacattggtttgtgccattactggtgcagtgactttcagccacttgggtaaggtggagttggccatatgtctccactgcaaaattactgattttccttttgtaattaataagtgtgtgtgtgaagattctttgagatgaggtatatatctc

SEQ ID NO: 305 - DNA, 301 bp, Homo sapien
  misc_feature (1)...(301): n = A,T,C or G
gangtacagcgtggtcaaggtaacaagaagaaaaaaatgtgagtggcatcctgggatgagcagggggacagacctggacagacacgttgtcatttgctgctgtgggtaggaaaatgggcgtaaaggaggagaaacagatacaaaatctccaactcagtattaaggtattctcatgcctagaatattggtagaaacaagaatacattcatatggcaaataactaaccatggtggaacaaaattctgggatttaagttggataccaangaaattgtattaaaagagctgttcatggaataaga

SEQ ID NO: 306 - protein, 8 aa, Homo sapien
VLGWVAEL

SEQ ID NO: 307 - DNA, 637 bp, Homo sapien
acagggratgaagggaaagggagaggatgaggaagcccccctggggatttggtttggtccttgtgatcaggtggtctatggggcttatccctacaaagaagaatccagaaataggggcacattgaggaatgatacttgagcccaaagagcattcaatcattgttttatttgccttmttttcacaccattggtgagggagggattaccaccctggggttatgaagatggttgaacaccccacacatagcaccggagatatgagatcaacagtttcttagccatagagattcacagcccagagcaggaggacgcttgcacaccatgcaggatgacatgggggatgcgctcgggattggtgtgaagaagcaaggactgttagaggcaggctttatagtaacaagacggtggggcaaactctgatttccgtgggggaatgtcatggtcttgctttactaagttttgagactggcaggtagtgaaactcattaggctgagaaccttgtggaatgcacttgacccasctgatagaggaagtagccaggtgggagcctttcccagtgggtgtgggacatatctggcaagattttgtggcactcctggttacagatactggggcagcaaataaaactgaatcttg

SEQ ID NO: 308 - DNA, 647 bp, Homo sapien
  misc_feature (1)...(647): n = A,T,C or G
acgattttcattatcatgtaaatcgggtcactcaaggggccaaccacagctgggagccactgctcaggggaaggttcatatgggactttctactgcccaaggttctatacaggatataaaggngcctcacagtatagatctggtagcaaagaagaagaaacaaacactgatctctttctgccacccctctgaccctttggaactcctctgaccctttagaacaagcctacctaatatctgctagagaaaagaccaacaacggcctcaaaggatctcttaccatgaaggtctcagctaattcttggctaagatgtgggttccacattaggttctgaatatggggggaagggtcaatttgctcattttgtgtgtggataaagtcaggatgcccaggggccagagcagggggctgcttgctttgggaacaatggctgagcatataaccataggttatggggaacaaaacaacatcaaagtcactgtatcaattgccatgaagacttgagggacctgaatctaccgattcatcttaaggcagcaggaccagtttgagtggcaacaatgcagcagcagaatcaatggaaacaacagaatgattgcaatgtccttttttttctcctgcttctgacttgataaaaggggaccgt

SEQ ID NO: 309 - DNA, 460 bp, Homo sapien
actttatagtttaggctggacattggaaaaaaaaaaaagccagaacaacatgtgatagataatatgattggctgcacacttccagactgatgaatgatgaacgtgatggactattgtatggagcacatcttcagcaagagggggaaatactcatcatttttggccagcagttgtttgatcaccaaacatcatgccagaatactcagcaaaccttcttagctcttgagaagtcaaagtccgggggaatttattcctggcaattttaattggactccttatgtgagagcagcggctacccagctggggtggtggagcgaacccgtcactagtggacatgcagtggcagagctcctggtaaccacctagaggaatacacaggcacatgtgtgatgccaagcgtgacacctgtagcactcaaatttgtcttgtttttgtctttcggtgtgtaagattcttaagt

SEQ ID NO: 310 - DNA, 539 bp, Homo sapien
acgggacttatcaaataaagataggaaaagaagaaaactcaaatattataggcagaaatgctaaaggttttaaaatatgtcaggattggaagaaggcatggataaagaacaaagttcagttaggaaagagaaacacagaaggaagagacacaataaaagtcattatgtattctgtgagaagtcagacagtaagatttgtgggaaatgggttggtttgttgtatggtatgtattttagcaataatctttatggcagagaaagctaaaatcctttagcttgcgtgaatgatcacttgctgaattcctcaaggtaggcatgatgaaggagggtttagaggagacacagacacaatgaactgacctagatagaaagccttagtatactcagctaggaatagtgattctgagggcacactgtgacatgattatgtcattacatgtatggtagtgatggggatgataggaaggaagaacttatggcatattttcacccccacaaaagtcagttaaatattgggacactaaccatccaggtcaaga

SEQ ID NO: 311 - DNA, 526 bp, Homo sapien
  misc_feature (1)...(526): n = A,T,C or G
caaatttgagccaatgacatagaattttacaaatcaagaagcttattctggggccatttcttttgacgttttctctaaactactaaagaggcattaatgatccataaattatattatctacatttacagcatttaaaatgtgttcagcatgaaatattagctacaggggaagctaaataaattaaacatggaataaagatttgtccttaaatataatctacaagaagactttgatatttgtttttcacaagtgaagcattcttataaagtgtcataacctttttggggaaactatgggaaaaaatggggaaactctgaagggttttaagtatcttacctgaagctacagactccataacctctctttacagggagctcctgcagcccctacagaaatgagtggctgagattcttgattgcacagcaagagcttctcatctaaaccctttccctttttagtatctgtgtatcaagtataaaagttctataaactgtagtntacttattttaatccccaaagcacagt

SEQ ID NO: 312 - DNA, 500 bp, Homo sapien
  misc_feature (1)...(500): n = A,T,C or G
cctctctctccccaccccctgactctagagaactgggttttctcccagtactccagcaattcatttctgaaagcagttgagccactttattccaaagtacactgcagatgttcaaactctccatttctctttcccttccacctgccagttttgctgactctcaacttgtcatgagtgtaagcattaaggacattatgcttcttcgattctgaagacaggccctgctcatggatgactctggcttcttaggaaaatatttttcttccaaaatcagtaggaaatctaaacttatcccctctttgcagatgtctagcagcttcagacatttggttaagaacccatgggaaaaaaaaaaatccttgctaatgtggtttcctttgtaaaccangattcttatttgnctggtatagaatatcagctctgaacgtgtggtaaagatttttgtgtttgaatataggagaaatcagtttgctgaaaagttagtcttaattatctattgg

SEQ ID NO: 313 - DNA, 718 bp, Homo sapien
  misc_feature (1)...(718): n = A,T,C or G
ggagatttgtgtggtttgcagccgagggagaccaggaagatctgcatggtgggaaggacctgatgatacagaggtgagaaataagaaaggctgctgactttaccatctgaggccacacatctgctgaaatggagataattaacatcactagaaacagcaagatgacaatataatgtctaagtagtgacatgtttttgcacatttccagcccttttaaatatccacacacacaggaagcacaaaaggaagcacagagatccctgggagaaatgcccggccgccatcttgggtcatcgatgagcctcgccctgtgcctgntcccgcttgtgagggaaggacattagaaaatgaattgatgtgttccttaaaggatggcaggaaaacagatcctgttgtggatatttatttgaacgggattacagatttgaaatgaagtcacaaagtgagcattaccaatgagaggaaaacagacgagaaaatcttgatggttcacaagacatgcaacaaacaaaatggaatactgtgatgacacgagcagccaactggggaggagataccacggggcagaggtcaggattctggccctgctgcctaactgtgcgttataccaatcatttctatttctaccctcaaacaagctgtngaatatctgacttacggttcttntggcccacattttcatnatccaccccntcnttttaannttantccaaantgt

SEQ ID NO: 314 - DNA, 358 bp, Homo sapien
gtttatttacattacagaaaaaacatcaagacaatgtatactatttcaaatatatccatacataatcaaatatagctgtagtacatgttttcattggtgtagattaccacaaatgcaaggcaacatgtgtagatctcttgtcttattcttttgtctataatactgtattgtgtagtccaagctctcggtagtccagccactgtgaaacatgctccctttagattaacctcgtggacgctcttgttgtattgctgaactgtagtgccctgtattttgcttctgtctgtgaattctgttgcttctggggcatttccttgtgatgcagaggaccaccacacagatgacagcaatctgaatt

SEQ ID NO: 315 - DNA, 341 bp, Homo sapien
taccacctccccgctggcactgatgagccgcatcaccatggtcaccagcaccatgaaggcataggtgatgatgaggacatggaatgggcccccaaggatggtctgtccaaagaagcgagtgacccccattctgaagatgtctggaacctctaccagcaggatgatgatagccccaatgacagtcaccagctccccgaccagccggatatcgtccttaggggtcatgtaggcttcctgaagtagcttctgctgtaagagggtgttgtcccgggggctcgtgcggttattggtcctgggcttgagggggcggtagatgcagcacatggtgaagcagatgatgt

SEQ ID NO: 316 - DNA, 151 bp, Homo sapien
agactgggcaagactcttacgccccacactgcaatttggtcttgttgccgtatccatttatgtgggcctttctcgagtttctgattataaacaccactggagcgatgtgttgactggactcattcagggagctctggttgcaatattagtt

SEQ ID NO: 317 - DNA, 151 bp, Homo sapien
agaactagtggatcctaatgaaatacctgaaacatatattggcatttatcaatggctcaaatcttcatttatctctggccttaaccctggctcctgaggctgcggccagcagatcccaggccagggctctgttcttgccacacctgcttga

SEQ ID NO: 318 - DNA, 151 bp, Homo sapien
actggtgggaggcgctgtttagttggctgttttcagaggggtctttcggagggacctcctgctgcaggctggagtgtctttattcctggcgggagaccgcacattccactgctgaggctgtgggggcggtttatcaggcagtgataaacat

SEQ ID NO: 319 - DNA, 151 bp, Homo sapien
aactagtggatccagagctataggtacagtgtgatctcagctttgcaaacacattttctacatagatagtactaggtattaatagatatgtaaagaaagaaatcacaccattaataatggtaagattgggtttatgtgattttagtgggta

SEQ ID NO: 320 - DNA, 150 bp, Homo sapien
aactagtggatccactagtccagtgtggtggaattccattgtgttggggttctagatcgcgagcggctgccctttttttttttttttttgggggggaattttttttttttaatagttattgagtgttctacagcttacagtaaataccat

SEQ ID NO: 321 - DNA, 151 bp, Homo sapien
agcaactttgtttttcatccaggttattttaggcttaggatttcctctcacactgcagtttagggtggcattgtaaccagctatggcataggtgttaaccaaaggctgagtaaacatgggtgcctctgagaaatcaaagtcttcatacact

SEQ ID NO: 322 - DNA, 151 bp, Homo sapien
  misc_feature (1)...(151): n = A,T,C or G
atccagcatcttctcctgtttcttgccttcctttttcttcttcttasattctgcttgaggtttgggcttggtcagtttgccacagggcttggagatggtgacagtcttctggcattcggcattgtgcagggctcgcttcanacttccagtt

SEQ ID NO: 323 - DNA, 151 bp, Homo sapien
  misc_feature (1)...(151): n = A,T,C or G
tgaggacttgtkttctttttctttatttttaatcctcttackttgtaaatatattgcctanagactcanttactacccagtttgtggttttwtgggagaaatgtaactggacagttagctgttcaatyaaaaagacacttancccatgtgg

SEQ ID NO: 324 - DNA, 461 bp, Homo sapien
  misc_feature (1)...(461): n = A,T,C or G
acctgtgtggaatttcagctttcctcatgcaaaaggattttgtatccccggcctacttgaagaagtggtcagctaaaggaatccaggttgttggttggactgttaatacctttgatgaaaagagttactacgaatcccatcttggttccagctatatcactgacagcatggtagaagactgcgaacctcacttctagactttcacggtgggacgaaacgggttcagaaactgccaggggcctcatacagggatatcaaaataccctttgtgctacccaggccctggggaatcaggtgactcacacaaatgcaatagttggtcactgcatttttacctgaaccaaagctaaacccggtgttgccaccatgcaccatggcatgccagagttcaacactgttgctcttgaaaattgggtctgaaaaaacgcacaagagcccctgccctgccctagctgangcac

SEQ ID NO: 325 - DNA, 400 bp, Homo sapien
acactgtttccatgttatgtttctacacattgctacctcagtgctcctggaaacttagcttttgatgtctccaagtagtccaccttcatttaactctttgaaactgtatcatctttgccaagtaagagtggtggcctatttcagctgctttgacaaaatgactggctcctgacttaacgttctataaatgaatgtgctgaagcaaagtgcccatggtggcggcgaagaagagaaagatgtgttttgttttggactctctgtggtcccttccaatgctgtgggtttccaaccaggggaagggtcccttttgcattgccaagtgccataaccatgagcactacgctaccatggttctgcctcctggccaagcaggctggtttgcaagaatgaaatgaatgat

SEQ ID NO: 326 - DNA, 1215 bp, Homo sapien
ggaggactgcagcccgcactcgcagccctggcaggcggcactggtcatggaaaacgaattgttctgctcgggcgtcctggtgcatccgcagtgggtgctgtcagccgcacactgtttccagaactcctacaccatcgggctgggcctgcacagtcttgaggccgaccaagagccagggagccagatggtggaggccagcctctccgtacggcacccagagtacaacagacccttgctcgctaacgacctcatgctcatcaagttggacgaatccgtgtccgagtctgacaccatccggagcatcagcattgcttcgcagtgccctaccgcggggaactcttgcctcgtttctggctggggtctgctggcgaacggcagaatgcctaccgtgctgcagtgcgtgaacgtgtcggtggtgtctgaggaggtctgcagtaagctctatgacccgctgtaccaccccagcatgttctgcgccggcggagggcaagaccagaaggactcctgcaacggtgactctggggggcccctgatctgcaacgggtacttgcagggccttgtgtctttcggaaaagccccgtgtggccaagttggcgtgccaggtgtctacaccaacctctgcaaattcactgagtggatagagaaaaccgtccaggccagttaactctggggactgggaacccatgaaattgacccccaaatacatcctgcggaaggaattcaggaatatctgttcccagcccctcctccctcaggcccaggagtccaggcccccagcccctcctccctcaaaccaagggtacagatccccagcccctcctccctcagacccaggagtccagaccccccagcccctcctccctcagacccaggagtccagcccctcctccctcagacccaggagtccagaccccccagcccctcctccctcagacccaggggtccaggcccccaacccctcctccctcagactcagaggtccaagcccccaacccctccttccccagacccagaggtccaggtcccagcccctcctccctcagacccagcggtccaatgccacctagactctccctgtacacagtgcccccttgtggcacgttgacccaaccttaccagttggtttttcattttttgtccctttcccctagatccagaaataaagtctaagagaagcgcaaaaaaaaaaaaaaaaaaaaaaaaaaaaaaaaaaaa

SEQ ID NO: 327 - protein, 220 aa, Homo sapien
EDCSPHSQPWQAALVMENELFCSGVLVHPQWVLSAAHCFQNSYTIGLGLHSLEADQEPGSQMVEASLSVRHPEYNRPLLANDLMLIKLDESVSESDTIRSISIASQCPTAGNSCLVSGWGLLANGRMPTVLQCVNVSVVSEEVCSKLYDPLYHPSMFCAGGGQDQKDSCNGDSGGPLICNGYLQGLVSFGKAPCGQVGVPGVYTNLCKFTEWIEKTVQAS

SEQ ID NO: 328 - DNA, 234 bp, Homo sapien
cgctcgtctctggtagctgcagccaaatcataaacggcgaggactgcagcccgcactcgcagccctggcaggcggcactggtcatggaaaacgaattgttctgctcgggcgtcctggtgcatccgcagtgggtgctgtcagccacacactgtttccagaactcctacaccatcgggctgggcctgcacagtcttgaggccgaccaagagccagggagccagatggtggaggcca

SEQ ID NO: 329 - protein, 77 aa, Homo sapien
LVSGSCSQIINGEDCSPHSQPWQAALVMENELFCSGVLVHPQWVLSATHCFQNSYTIGLGLHSLEADQEPGSQMVEA

SEQ ID NO: 330 - DNA, 70 bp, Homo sapien
cccaacacaatggcccgatcccatccctgactccgccctcaggatcgctcgtctctggtagctgcagcca

SEQ ID NO: 331 - protein, 22 aa, Homo sapien
QHNGPIPSLTPPSGSLVSGSCS

SEQ ID NO: 332 - DNA, 2507 bp, Homo sapien
tggtgccgctgcagccggcagagatggttgagctcatgttcccgctgttgctcctccttctgcccttccttctgtatatggctgcgccccaaatcaggaaaatgctgtccagtggggtgtgtacatcaactgttcagcttcctgggaaagtagttgtggtcacaggagctaatacaggtatcgggaaggagacagccaaagagctggctcagagaggagctcgagtatatttagcttgccgggatgtggaaaagggggaattggtggccaaagagatccagaccacgacagggaaccagcaggtgttggtgcggaaactggacctgtctgatactaagtctattcgagcttttgctaagggcttcttagctgaggaaaagcacctccacgttttgatcaacaatgcaggagtgatgatgtgtccgtactcgaagacagcagatggctttgagatgcacataggagtcaaccacttgggtcacttcctcctaacccatctgctgctagagaaactaaaggaatcagccccatcaaggatagtaaatgtgtcttccctcgcacatcacctgggaaggatccacttccataacctgcagggcgagaaattctacaatgcaggcctggcctactgtcacagcaagctagccaacatcctcttcacccaggaactggcccggagactaaaaggctctggcgttacgacgtattctgtacaccctggcacagtccaatctgaactggttcggcactcatctttcatgagatggatgtggtggcttttctcctttttcatcaagactcctcagcagggagcccagaccagcctgcactgtgccttaacagaaggtcttgagattctaagtgggaatcatttcagtgactgtcatgtggcatgggtctctgcccaagctcgtaatgagactatagcaaggcggctgtgggacgtcagttgtgacctgctgggcctcccaatagactaacaggcagtgccagttggacccaagagaagactgcagcagactacacagtacttcttgtcaaaatgattctccttcaaggttttcaaaacctttagcacaaagagagcaaaaccttccagccttgcctgcttggtgtccagttaaaactcagtgtactgccagattcgtctaaatgtctgtcatgtccagatttactttgcttctgttactgccagagttactagagatatcataataggataagaagaccctcatatgacctgcacagctcattttccttctgaaagaaactactacctaggagaatctaagctatagcagggatgatttatgcaaatttgaactagcttctttgttcacaattcagttcctcccaaccaaccagtcttcacttcaagagggccacactgcaacctcagcttaacatgaataacaaagactggctcaggagcagggcttgcccaggcatggtggatcaccggaggtcagtagttcaagaccagcctggccaacatggtgaaaccccacctctactaaaaattgtgtatatctttgtgtgtcttcctgtttatgtgtgccaagggagtattttcacaaagttcaaaacagccacaataatcagagatggagcaaaccagtgccatccagtctttatgcaaatgaaatgctgcaaagggaagcagattctgtatatgttggtaactacccaccaagagcacatgggtagcagggaagaagtaaaaaaagagaaggagaatactggaagataatgcacaaaatgaagggactagttaaggattaactagccctttaaggattaactagttaaggattaatagcaaaagayattaaatatgctaacatagctatggaggaattgagggcaagcacccaggactgatgaggtcttaacaaaaaccagtgtggcaaaaaaaaaaaaaaaaaaaaaaaaaaatcctaaaaacaaacaaacaaaaaaaacaattcttcattcagaaaaattatcttagggactgatattggtaattatggtcaatttaataatattttggggcatttccttacattgtcttgacaagattaaaatgtctgtgccaaaattttgtattttatttggagacttcttatcaaaagtaatgctgccaaaggaagtctaaggaattagtagtgttcccatcacttgtttggagtgtgctattctaaaagattttgatttcctggaatgacaattatattttaactttggtgggggaaagagttataggaccacagtcttcacttctgatacttgtaaattaatcttttattgcacttgttttgaccattaagctatatgtttagaaatggtcattttacggaaaaattagaaaaattctgataatagtgcagaataaatgaattaatgttttacttaatttatattgaactgtcaatgacaaataaaaattctttttgattattttttgttttcatttaccagaataaaaacgtaagaattaaaagtttgattacaaaaaaaaaaaaaaa

SEQ ID NO: 333 - DNA, 3030 bp, Homo sapien
gcaggcgacttgcgagctgggagcgatttaaaacgctttggattcccccggcctgggtggggagagcgagctgggtgccccctagattccccgcccccgcacctcatgagccgaccctcggctccatggagcccggcaattatgccaccttggatggagccaaggatatcgaaggcttgctgggagcgggaggggggcggaatctggtcgcccactcccctctgaccagccacccagcggcgcctacgctgatgcctgctgtcaactatgcccccttggatctgccaggctcggcggagccgccaaagcaatgccacccatgccctggggtgccccaggggacgtccccagctcccgtgccttatggttactttggaggcgggtactactcctgccgagtgtcccggagctcgctgaaaccctgtgcccaggcagccaccctggccgcgtaccccgcggagactcccacggccggggaagagtaccccagycgccccactgagtttgccttctatccgggatatccgggaacctaccagcctatggccagttacctggacgtgtctgtggtgcagactctgggtgctcctggagaaccgcgacatgactccctgttgcctgtggacagttaccagtcttgggctctcgctggtggctggaacagccagatgtgttgccagggagaacagaacccaccaggtcccttttggaaggcagcatttgcagactccagcgggcagcaccctcctgacgcctgcgcctttcgtcgcggccgcaagaaacgcattccgtacagcaaggggcagttgcgggagctggagcgggagtatgcggctaacaagttcatcaccaaggacaagaggcgcaagatctcggcagccaccagcctctcggagcgccagattaccatctggtttcagaaccgccgggtcaaagagaagaaggttctcgccaaggtgaagaacagcgctaccccttaagagatctccttgcctgggtgggaggagcgaaagtgggggtgtcctggggagaccaggaacctgccaagcccaggctggggccaaggactctgctgagaggcccctagagacaacacccttcccaggccactggctgctggactgttcctcaggagcggcctgggtacccagtatgtgcagggagacggaaccccatgtgacagcccactccaccagggttcccaaagaacctggcccagtcataatcattcatcctgacagtggcaataatcacgataaccagtactagctgccatgatcgttagcctcatattttctatctagagctctgtagagcactttagaaaccgctttcatgaattgagctaattatgaataaatttggaaggcgatccctttgcagggaagctttctctcagacccccttccattacacctctcaccctggtaacagcaggaagactgaggagaggggaacgggcagattcgttgtgtggctgtgatgtccgtttagcatttttctcagctgacagctgggtaggtggacaattgtagaggctgtctcttcctccctccttgtccaccccatagggtgtacccactggtcttggaagcacccatccttaatacgatgatttttctgtcgtgtgaaaatgaagccagcaggctgcccctagtcagtccttccttccagagaaaaagagatttgagaaagtgcctgggtaattcaccattaatttcctcccccaaactctctgagtcttcccttaatatttctggtggttctgaccaaagcaggtcatggtttgttgagcatttgggatcccagtgaagtagatgtttgtagccttgcatacttagcccttcccaggcacaaacggagtggcagagtggtgccaaccctgttttcccagtccacgtagacagattcacagtgcggaattctggaagctggagacagacgggctctttgcagagccgggactctgagagggacatgagggcctctgcctctgtgttcattctctgatgtcctgtacctgggctcagtgcccggtgggactcatctcctggccgcgcagcaaagccagcgggttcgtgctggtccttcctgcaccttaggctgggggtggggggcctgccggcgcattctccacgattgagcgcacaggcctgaagtctggacaacccgcagaaccgaagctccgagcagcgggtcggtggcgagtagtggggtcggtggcgagcagttggtggtgggccgcggccgccactacctcgaggacatttccctcccggagccagctctcctagaaaccccgcggcggccgccgcagccaagtgtttatggcccgcggtcgggtgggatcctagccctgtctcctctcctgggaaggagtgagggtgggacgtgacttagacacctacaaatctatttaccaaagaggagcccgggactgagggaaaaggccaaagagtgtgagtgcatgcggactgggggttcaggggaagaggacgaggaggaggaagatgaggtcgatttcctgatttaaaaaatcgtccaagccccgtggtccagcttaaggtcctcggttacatgcgccgctcagagcaggtcactttctgccttccacgtcctccttcaaggaagccccatgtgggtagctttcaatatcgcaggttcttactcctctgcctctataagctcaaacccaccaacgatcgggcaagtaaaccccctccctcgccgacttcggaactggcgagagttcagcgcagatgggcctgtggggagggggcaagatagatgagggggagcggcatggtgcggggtgaccccttggagagaggaaaaaggccacaagaggggctgccaccgccactaacggagatggccctggtagagacctttgggggtctggaacctctggactccccatgctctaactcccacactctgctatcagaaacttaaacttgaggattttctctgtttttcactcgcaataaaytcagagcaaacaaaaaaaaaaaaaaaaaaaaactcgag

SEQ ID NO: 334 - DNA, 2417 bp, Homo sapien
ggcggccgctctagagctagtgggatcccccgggctgcacgaattcggcacgagtgagttggagttttacctgtattgttttaatttcaacaagcctgaggactagccacaaatgtacccagtttacaaatgaggaaacaggtgcaaaaaggttgttacctgtcaaaggtcgtatgtggcagagccaagatttgagcccagttatgtctgatgaacttagcctatgctctttaaacttctgaatgctgaccattgaggatatctaaacttagatcaattgcattttccctccaagactatttacttatcaatacaataataccacctttaccaatctattgttttgatacgagactcaaatatgccagatatatgtaaaagcaacctacaagctctctaatcatgctcacctaaaagattcccgggatctaataggctcaaagaaacttcttctagaaatataaaagagaaaattggattatgcaaaaattcattattaatttttttcatccatcctttaattcagcaaacatttatctgttgttgactttatgcagtatggccttttaaggattgggggacaggtgaagaacggggtgccagaatgcatcctcctactaatgaggtcagtacacatttgcattttaaaatgccctgtccagctgggcatggtggatcatgcctgtaatctcaacattggaaggccaaggcaggaggattgcttcagcccaggagttcaagaccagcctgggcaacatagaaagaccccatctctcaatcaatcaatcaatgccctgtctttgaaaataaaactctttaagaaaggtttaatgggcagggtgtggtagctcatgcctataatacagcactttgggaggctgaggcaggaggatcactttagcccagaagttcaagaccagcctgggcaacaagtgacacctcatctcaattttttaataaaatgaatacatacataaggaaagataaaaagaaaagtttaatgaaagaatacagtataaaacaaatctcttggacctaaaagtatttttgttcaagccaaatattgtgaatcacctctctgtgttgaggatacagaatatctaagcccaggaaactgagcagaaagttcatgtactaactaatcaacccgaggcaaggcaaaaatgagactaactaatcaatccgaggcaaggggcaaattagacggaacctgactctggtctattaagcgacaactttccctctgttgtatttttcttttattcaatgtaaaaggataaaaactctctaaaactaaaaacaatgtttgtcaggagttacaaaccatgaccaactaattatggggaatcataaaatatgactgtatgagatcttgatggtttacaaagtgtacccactgttaatcactttaaacattaatgaacttaaaaatgaatttacggagattggaatgtttctttcctgttgtattagttggctcaggctgccataacaaaataccacagactgggaggcttaagtaacagaaattcatttctcacagttctgggggctggaagtccacgatcaaggtgcaggaaaggcaggcttcattctgaggcccctctcttggctcacatgtggccaccctcccactgcgtgctcacatgacctctttgtgctcctggaaagagggtgtgggggacagagggaaagagaaggagagggaactctctggtgtctcgtctttcaaggaccctaacctgggccactttggcccaggcactgtggggtggggggttgtggctgctctgctctgagtggccaagataaagcaacagaaaaatgtccaaagctgtgcagcaaagacaagccaccgaacagggatctgctcatcagtgtggggacctccaagtcggccaccctggaggcaagcccccacagagcccatgcaaggtggcagcagcagaagaagggaattgtccctgtccttggcacattcctcaccgacctggtgatgctggacactgcgatgaatggtaatgtggatgagaatatgatggactcccagaaaaggagacccagctgctcaggtggctgcaaatcattacagccttcatcctggggaggaactgggggcctggttctgggtcagagagcagcccagtgagggtgagagctacagcctgtcctgccagctggatccccagtcccggtcaaccagtaatcaaggctgagcagatcaggcttcccggagctggtcttgggaagccagccctggggtgagttggctcctgctgtggtactgagacaatattgtcataaattcaatgcgcccttgtatccctttttcttttttatctgtctacatctataatcactatgcatactagtctttgttagtgtttctattcmacttaatagagatatgttatact

SEQ ID NO: 335 - DNA, 2984 bp, Homo sapien
atccctccttccccactctcctttccagaaggcacttggggtcttatctgttggactctgaaaacacttcaggcgcccttccaaggcttccccaaacccctaagcagccgcagaagcgctcccgagctgccttctcccacactcaggtgatcgagttggagaggaagttcagccatcagaagtacctgtcggcccctgaacgggcccacctggccaagaacctcaagctcacggagacccaagtgaagatatggttccagaacagacgctataagactaagcgaaagcagctctcctcggagctgggagacttggagaagcactcctctttgccggccctgaaagaggaggccttctcccgggcctccctggtctccgtgtataacagctatccttactacccatacctgtactgcgtgggcagctggagcccagctttttggtaatgccagctcaggtgacaaccattatgatcaaaaactgccttccccagggtgtctctatgaaaagcacaaggggccaaggtcagggagcaagaggtgtgcacaccaaagctattggagatttgcgtggaaatctcasattcttcactggtgagacaatgaaacaacagagacagtgaaagttttaatacctaagtcattcccccagtgcatactgtaggtcattttttttgcttctggctacctgtttgaaggggagagagggaaaatcaagtggtattttccagcactttgtatgattttggatgagctgtacacccaaggattctgttctgcaactccatcctcctgtgtcactgaatatcaactctgaaagagcaaacctaacaggagaaaggacaaccaggatgaggatgtcaccaactgaattaaacttaagtccagaagcctcctgttggccttggaatatggccaaggctctctctgtccctgtaaaagagaggggcaaatagagagtctccaagagaacgccctcatgctcagcacatatttgcatgggagggggagatgggtgggaggagatgaaaatatcagcttttcttattcctttttattccttttaaaatggtatgccaacttaagtatttacagggtggcccaaatagaacaagatgcactcgctgtgattttaagacaagctgtataaacagaactccactgcaagagggggggccgggccaggagaatctccgcttgtccaagacaggggcctaaggagggtctccacactgctgctaggggctgttgcatttttttattagtagaaagtggaaaggcctcttctcaacttttttcccttgggctggagaatttagaatcagaagtttcctggagttttcaggctatcatatatactgtatcctgaaaggcaacataattcttccttccctccttttaaaattttgtgttcctttttgcagcaattactcactaaagggcttcattttagtccagatttttagtctggctgcacctaacttatgcctcgcttatttagcccgagatctggtctttttttttttttttttttttccgtctccccaaagctttatctgtcttgactttttaaaaaagtttgggggcagattctgaattggctaaaagacatgcatttttaaaactagcaactcttatttctttcctttaaaaatacatagcattaaatcccaaatcctatttaaagacctgacagcttgagaaggtcactactgcatttataggaccttctggtggttctgctgttacgtttgaagtctgacaatccttgagaatctttgcatgcagaggaggtaagaggtattggattttcacagaggaagaacacagcgcagaatgaagggccaggcttactgagctgtccagtggagggctcatgggtgggacatggaaaagaaggcagcctaggccctggggagcccagtccactgagcaagcaagggactgagtgagccttttgcaggaaaaggctaagaaaaaggaaaaccattctaaaacacaacaagaaactgtccaaatgctttgggaactgtgtttattgcctataatgggtccccaaaatgggtaacctagacttcagagagaatgagcagagagcaaaggagaaatctggctgtccttccattttcattctgttatctcaggtgagctggtagaggggagacattagaaaaaaatgaaacaacaaaacaattactaatgaggtacgctgaggcctgggagtctcttgactccactacttaattccgtttagtgagaaacctttcaattttcttttattagaagggccagcttactgttggtggcaaaattgccaacataagttaatagaaagttggccaatttcaccccattttctgtggtttgggctccacattgcaatgttcaatgccacgtgctgctgacaccgaccggagtactagccagcacaaaaggcagggtagcctgaattgctttctgctctttacatttcttttaaaataagcatttagtgctcagtccctactgagtactctttctctcccctcctctgaatttaattctttcaacttgcaatttgcaaggattacacatttcactgtgatgtatattgtgttgcaaaaaaaaaaaaaagtgtctttgtttaaaattacttggtttgtgaatccatcttgctttttccccattggaactagtcattaacccatctctgaactggtagaaaaacatctgaagagctagtctatcagcatctgacaggtgaattggatggttctcagaaccatttcacccagacagcctgtttctatcctgtttaataaattagtttgggttctctacatgcataacaaaccctgctccaatctgtcacataaaagtctgtgacttgaagtttagtcagcacccccaccaaactttatttttctatgtgttttttgcaacatatgagtgttttgaaaataaagtacccatgtctttattagaaaaaaaaaaaaaaaaaaaaaa

SEQ ID NO: 336 - protein, 147 aa, Homo sapien
PSFPTLLSRRHLGSYLLDSENTSGALPRLPQTPKQPQKRSRAAFSHTQVIELERKFSHQKYLSAPERAHLAKNLKLTETQVKIWFQNRRYKTKRKQLSSELGDLEKHSSLPALKEEAFSRASLVSVYNSYPYYPYLYCVGSWSPAFW

SEQ ID NO: 337 - protein, 9 aa, Homo sapien
ALTGFTFSA

SEQ ID NO: 338 - protein, 9 aa, Homo sapien
LLANDLMLI

SEQ ID NO: 339 - protein, 318 aa, Homo sapien
MVELMFPLLLLLLPFLLYMAAPQIRKMLSSGVCTSTVQLPGKVVVVTGANTGIGKETAKELAQRGARVYLACRDVEKGELVAKEIQTTTGNQQVLVRKLDLSDTKSIRAFAKGFLAEEKHLHVLINNAGVMMCPYSKTADGFEMHIGVNHLGHFLLTHLLLEKLKESAPSRIVNVSSLAHHLGRIHFHNLQGEKFYNAGLAYCHSKLANILFTQELARRLKGSGVTTYSVHPGTVQSELVRHSSFMRWMWWLFSFFIKTPQQGAQTSLHCALTEGLEILSGNHFSDCHVAWVSAQARNETIARRLWDVSCDLLGLPID

SEQ ID NO: 340 - DNA, 483 bp, Homo sapien
gccgaggtctgccttcacacggaggacacgagactgcttcctcaagggctcctgcctgcctggacactggtgggaggcgctgtttagttggctgttttcagaggggtctttcggagggacctcctgctgcaggctggagtgtctttattcctggcgggagaccgcacattccactgctgaggttgtgggggcggtttatcaggcagtgataaacataagatgtcatttccttgactccggccttcaattttctctttggctgacgacggagtccgtggtgtcccgatgtaactgacccctgctccaaacgtgacatcactgatgctcttctcgggggtgctgatggcccgcttggtcacgtgctcaatctcgccattcgactcttgctccaaactgtatgaagacacctgactgcacgttttttctgggcttccagaatttaaagtgaaaggcagcactcctaagctccgactccgatgcctg

SEQ ID NO: 341 - DNA, 344 bp, Homo sapien
ctgctgctgagtcacagatttcattataaatagcctccctaaggaaaatacactgaatgctatttttactaaccattctatttttatagaaatagctgagagtttctaaaccaactctctgctgccttacaagtattaaatattttacttctttccataaagagtagctcaaaatatgcaattaatttaataatttctgatgatggttttatctgcagtaatatgtatatcatctattagaatttacttaatgaaaaactgaagagaacaaaatttgtaaccactagcacttaagtactcctgattcttaacattgtctttaatgaccacaagacaaccaacag

SEQ ID NO: 342 - DNA, 592 bp, Homo sapien
acagcaaaaaagaaactgagaagcccaatytgctttcttgttaacatccacttatccaaccaatgtggaaacttcttatacttggttccattatgaagttggacaattgctgctatcacacctggcaggtaaaccaatgccaagagagtgatggaaaccattggcaagactttgttgatgaccaggattggaattttataaaaatattgttgatgggaagttgctaaagggtgaattacttccctcagaagagtgtaaagaaaagtcagagatgctataatagcagctattttaattggcaagtgccactgtggaaagagttcctgtgtgtgctgaagttctgaagggcagtcaaattcatcagcatgggctgtttggtgcaaatgcaaaagcacaggtctttttagcatgctggtctctcccgtgtccttatgcaaataatcgtcttcttctaaatttctcctaggcttcattttccaaagttcttcttggtttgtgatgtcttttctgctttccattaattctataaaatagtatggcttcagccacccactcttcgccttagcttgaccgtgagtctcggctgccgctg

SEQ ID NO: 343 - DNA, 382 bp, Homo sapien
ttcttgacctcctcctccttcaagctcaaacaccacctcccttattcaggaccggcacttcttaatgtttgtggctttctctccagcctctcttaggaggggtaatggtggagttggcatcttgtaactctcctttctcctttcttcccctttctctgcccgcctttcccatcctgctgtagacttcttgattgtcagtctgtgtcacatccagtgattgttttggtttctgttccctttctgactgcccaaggggctcagaaccccagcaatcccttcctttcactaccttcttttttgggggtagttggaagggactgaaattgtggggggaaggtaggaggcacatcaataaagaggaaaccaccaagctgaaaaaaaa

SEQ ID NO: 344 - DNA, 536 bp, Homo sapien
ctgggcctgaagctgtagggtaaatcagaggcaggcttctgagtgatgagagtcctgagacaataggccacataaacttggctggatggaacctcacaataaggtggtcacctcttgtttgtttagggggatgccaaggataaggccagctcagttatatgaagagaagcagaacaaacaagtctttcagagaaatggatgcaatcagagtgggatcccggtcacatcaaggtcacactccaccttcatgtgcctgaatggttgccaggtcagaaaaatccaccccttacgagtgcggcttcgaccctatatcccccgcccgcgtccctttctccataaaattcttcttagtagctattaccttcttattatttgatctagaaattgccctccttttacccctaccatgagccctacaaacaactaacctgccactaatagttatgtcatccctcttattaatcatcatcctagccctaagtctggcctatgagtgactacaaaaaggattagactgagccgaataacaaaaaaaa

SEQ ID NO: 345 - DNA, 251 bp, Homo sapien
accttttgaggtctctctcaccacctccacagccaccgtcaccgtgggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacatatcggatttggagagacactgccaactggctggagattaatccggacactggtgccatttcc

SEQ ID NO: 346 - DNA, 282 bp, Homo sapien
  misc_feature (1)...(282): n = A,T,C or G
cgcgtctctgacactgtgatcatgacaggggttcaaacagaaagtgcctgggccctccttctaagtcttgttaccaaaaaaaggaaaaagaaaagatcttctcagttacaaattctgggaagggagactatacctggctcttgccctaagtgagaggtcttccctcccgcaccaaaaaatagaaaggctttctatttcactggcccaggtagggggaaggagagtaactttgagtctgtgggtctcatttcccaaggtgccttcaatgctcatnaaaaccaa

SEQ ID NO: 347 - DNA, 201 bp, Homo sapien
  misc_feature (1)...(201): n = A,T,C or G
acacacataatattataaaatgccatctaattggaaggagctttctatcattgcaagtcataaatataacttttaaaanantactancagcttttacctangctcctaaatgcttgtaaatctgagactgactggacccacccagacccagggcaaagatacatgttaccatatcatctttataaagaatttttttttgtc

SEQ ID NO: 348 - DNA, 251 bp, Homo sapien
ctgttaatcacaacatttgtgcatcacttgtgccaagtgagaaaatgttctaaaatcacaagagagaacagtgccagaatgaaactgaccctaagtcccaggtgcccctgggcaggcagaaggagacactcccagcatggaggagggtttatcttttcatcctaggtcaggtctacaatgggggaaggttttattatagaactcccaacagcccacctcactcctgccacccacccgatggccctgcctcc

SEQ ID NO: 349 - DNA, 251 bp, Homo sapien
taaaaatcaagccatttaattgtatctttgaaggtaaacaatatatgggagctggatcacaacccctgaggatgccagagctatgggtccagaacatggtgtggtattatcaacagagttcagaagggtctgaactctacgtgttaccagagaacataatgcaattcatgcattccacttagcaattttgtaaaataccagaaacagaccccaagagtctttcaagatgaggaaaattcaactcctggttt

SEQ ID NO: 350 - DNA, 908 bp, Homo sapien
ctggacactttgcgagggcttttgctggctgctgctgctgcccgtcatgctactcatcgtagcccgcccggtgaagctcgctgctttccctacctccttaagtgactgccaaacgcccaccggctggaattgctctggttatgatgacagagaaaatgatctcttcctctgtgacaccaacacctgtaaatttgatggggaatgtttaagaattggagacactgtgacttgcgtctgtcagttcaagtgcaacaatgactatgtgcctgtgtgtggctccaatggggagagctaccagaatgagtgttacctgcgacaggctgcatgcaaacagcagagtgagatacttgtggtgtcagaaggatcatgtgccacagtccatgaaggctctggagaaactagtcaaaaggagacatccacctgtgatatttgccagtttggtgcagaatgtgacgaagatgccgaggatgtctggtgtgtgtgtaatattgactgttctcaaaccaacttcaatcccctctgcgcttctgatgggaaatcttatgataatgcatgccaaatcaaagaagcatcgtgtcagaaacaggagaaaattgaagtcatgtctttgggtcgatgtcaagataacacaactacaactactaagtctgaagatgggcattatgcaagaacagattatgcagagaatgctaacaaattagaagaaagtgccagagaacaccacataccttgtccggaacattacaatggcttctgcatgcatgggaagtgtgagcattctatcaatatgcaggagccatcttgcaggtgtgatgctggttatactggacaacactgtgaaaaaaaggactacagtgttctatacgttgttcccggtcctgtacgatttcagtatgtcttaatcgcag

SEQ ID NO: 351 - DNA, 472 bp, Homo sapien
ccagttatttgcaagtggtaagagcctatttaccataaataatactaagaaccaactcaagtcaaaccttaatgccattgttattgtgaattaggattaagtagtaattttcaaaattcacattaacttgattttaaaatcagwtttgygagtcatttaccacaagctaaatgtgtacactatgataaaaacaaccattgtattcctgtttttctaaacagtcctaatttctaacactgtatatatccttcgacatcaatgaactttgttttcttttactccagtaataaagtaggcacagatctgtccacaacaaacttgccctctcatgccttgcctctcaccatgctctgctccaggtcagcccccttttggcctgtttgttttgtcaaaaacctaatctgcttcttgcttttcttggtaatatatatttagggaagatgttgctttgcccacacacgaagcaaagtaa

SEQ ID NO: 352 - DNA, 251 bp, Homo sapien
ctcaaagctaatctctcgggaatcaaaccagaaaagggcaaggatcttaggcatggtggatgtggataaggccaggtcaatggctgcaagcatgcagagaaagaggtacatcggagcgtgcaggctgcgttccgtccttacgatgaagaccacgatgcagtttccaaacattgccactacatacatggaaaggagggggaagccaacccagaaatgggctttctctaatcctgggataccaataagcacaa

SEQ ID NO: 353 - DNA, 436 bp, Homo sapien
ttttttttttttttttttttttttttacaacaatgcagtcatttatttattgagtatgtgcacattatggtattattactatactgattatatttatcatgtgacttctaattaraaaatgtatccaaaagcaaaacagcagatatacaaaattaaagagacagaagatagacattaacagataaggcaacttatacattgacaatccaaatccaatacatttaaacatttgggaaatgagggggacaaatggaagccaratcaaatttgtgtaaaactattcagtatgtttcccttgcttcatgtctgaraaggctctcccttcaatggggatgacaaactccaaatgccacacaaatgttaacagaatactagattcacactggaacgggggtaaagaagaaattattttctataaaagggctcctaatgtagt

SEQ ID NO: 354 - DNA, 854 bp, Homo sapien
ccttttctagttcaccagttttctgcaaggatgctggttagggagtgtctgcaggaggagcaagtctgaaaccaaatctaggaaacataggaaacgagccaggcacagggctggtgggccatcagggaccaccctttgggttgatattttgcttaatctgcatcttttgagtaagatcatctggcagtagaagctgttctccaggtacatttctctagctcatgtacaaaaacatcctgaaggactttgtcaggtgccttgctaaaagccagatgcgttcggcacttccttggtctgaggttaattgcacacctacaggcactgggctcatgctttcaagtattttgtcctcactttagggtgagtgaaagatccccattataggagcacttgggagagatcatataaaagctgactcttgagtacatgcagtaatggggtagatgtgtgtggtgtgtcttcattcctgcaagggtgcttgttagggagtgtttccaggaggaacaagtctgaaaccaatcatgaaataaatggtaggtgtgaactggaaaactaattcaaaagagagatcgtgatatcagtgtggttgatacaccttggcaatatggaaggctctaatttgcccatatttgaaataataattcagctttttgtaatacaaaataacaaaggattgagaatcatggtgtctaatgtataaaagacccaggaaacataaatatatcaactgcataaatgtaaaatgcatgtgacccaagaaggccccaaagtggcagacaacattgtacccattttcccttccaaaatgtgagcggcgggcctgctgctttcaaggctgtcacacgggatgtcag

SEQ ID NO: 355 - DNA, 676 bp, Homo sapien
gaaattaagtatgagctaaattccctgttaaaacctctaggggtgacagatctcttcaaccaggtcaaagctgatctttctggaatgtcaccaaccaagggcctatatttatcaaaagccatccacaagtcatacctggatgtcagcgaagagggcacggaggcagcagcagccactggggacagcatcgctgtaaaaagcctaccaatgagagctcagttcaaggcgaaccaccccttcctgttctttataaggcacactcataccaacacgatcctattctgtggcaagcttgcctctccctaatcagatggggttgagtaaggctcagagttgcagatgaggtgcagagacaatcctgtgactttcccacggccaaaaagctgttcacacctcacgcacctctgtgcctcagtttgctcatctgcaaaataggtctaggatttcttccaaccatttcatgagttgtgaagctaaggctttgttaatcatggaaaaaggtagacttatgcagaaagcctttctggctttcttatctgtggtgtctcatttgagtgctgtccagtgacatgatcaagtcaatgagtaaaattttaagggattagattttcttgacttgtatgtatctgtgagatcttgaataagtgacctgacatctctgcttaaagaaaaccag

SEQ ID NO: 356 - DNA, 574 bp, Homo sapien
tttttttttttttttcaggaaaacattctcttactttatttgcatctcagcaaaggttctcatgtggcacctgactggcatcaaaccaaagttcgtaggccaacaaagatgggccactcacaagcttcccatttgtagatctcagtgcctatgagtatctgacacctgttcctctcttcagtctcttagggaggcttaaatctgtctcaggtgtgctaagagtgccagcccaaggkggtcaaaagtccacaaaactgcagtctttgctgggatagtaagccaagcagtgcctggacagcagagttcttttcttgggcaacagataaccagacaggactctaatcgtgctcttattcaacattcttctgtctctgcctagactggaataaaaagccaatctctctcgtggcacagggaaggagatacaagctcgtttacatgtgatagatctaacaaaggcatctaccgaagtctggtctggatagacggcacagggagctcttaggtcagcgctgctggttggaggacattcctgagtccagctttgcagcctttgtgcaacagtactttccca

SEQ ID NO: 357 - DNA, 393 bp, Homo sapien
tttttttttttttttttttttttttttttttacagaatataratgctttatcactgkacttaatatggkgkcttgttcactatacttaaaaatgcaccactcataaatatttaattcagcaagccacaaccaaracttgattttatcaacaaaaacccctaaatataaacggsaaaaaagatagatataattattccagtttttttaaaacttaaaaratattccattgccgaattaaraaraarataagtgttatatggaaagaagggcattcaagcacactaaaraaacctgaggkaagcataatctgtacaaaattaaactgtcctttttggcattttaacaaatttgcaacgktcttttttttctttttctgtttttttttttttttac

SEQ ID NO: 358 - DNA, 630 bp, Homo sapien
acagggtaaacaggaggatccttgctctcacggagcttacattctagcaggaggacaatattaatgtttataggaaaatgatgagtttatgacaaaggaagtagatagtgttttacaagagcatagagtagggaagctaatccagcacagggaggtcacagagacatccctaaggaagtggagtttaaactgagagaagcaagtgcttaaactgaaggatgtgttgaagaagaagggagagtagaacaatttgggcagagggaaccttatagaccctaaggtgggaaggttcaaagaactgaaagagagctagaacagctggagccgttctccggtgtaaagaggagtcaaagagataagattaaagatgtgaagattaagatcttggtggcattcagggattggcacttctacaagaaatcactgaagggagtaatgtgacattacttttcacttcaggatggccattctaactccagggggtagactggactaggtaagactggaggcaggtagacctcttctaaggcctgcgatagtgaaagacaaaaataagtggggaaattcaggggatagtgaaaatcagtaggacttaatgagcaagccagaggttcctccacaacaaccagt

SEQ ID NO: 359 - DNA, 620 bp, Homo sapien
acagcattccaaaatatacatctagagactaarrgtaaatgctctatagtgaagaagtaataattaaaaaatgctactaatatagaaaatttataatcagaaaaataaatattcagggagctcaccagaagaataaagtgctctgccagttattaaaggattactgctggtgaattaaatatggcattccccaagggaaatagagagattcttctggattatgttcaatatttatttcacaggattaactgttttaggaacagatataaagcttcgccacggaagagatggacaaagcacaaagacaacatgataccttaggaagcaacactaccctttcaggcataaaatttggagaaatgcaacattatgcttcatgaataatatgtagaaagaaggtctgatgaaaatgacatccttaatgtaagataactttataagaattctgggtcaaataaaattctttgaagaaaacatccaaatgtcattgacttatcaaatactatcttggcatataacctatgaaggcaaaactaaacaaacaaaaagctcacaccaaacaaaaccatcaacttattttgtattctataacatacgagactgtaaagatgtgacagtgt

SEQ ID NO: 360 - DNA, 431 bp, Homo sapien
aaaaaaaaaaagccagaacaacatgtgatagataatatgattggctgcacacttccagactgatgaatgatgaacgtgatggactattgtatggagcacatcttcagcaagagggggaaatactcatcatttttggccagcagttgtttgatcaccaaacatcatgccagaatactcagcaaaccttcttagctcttgagaagtcaaagtccgggggaatttattcctggcaattttaattggactccttatgtgagagcagcggctacccagctggggtggtggagcgaacccgtcactagtggacatgcagtggcagagctcctggtaaccacctagaggaatacacaggcacatgtgtgatgccaagcgtgacacctgtagcactcaaatttgtcttgtttttgtctttcggtgtgtagattcttagt

SEQ ID NO: 361 - DNA, 351 bp, Homo sapien
acactgatttccgatcaaaagaatcatcatctttaccttgacttttcagggaattactgaactttcttctcagaagatagggcacagccattgccttggcctcacttgaagggtctgcatttgggtcctctggtctcttgccaagtttcccagccactcgagggagaaatatcgggaggtttgacttcctccggggctttcccgagggcttcaccgtgagccctgcggccctcagggctgcaatcctggattcaatgtctgaaacctcgctctctgcctgctggacttctgaggccgtcactgccactctgtcctccagctctgacagctcctcatctgtggtcctgttgt

SEQ ID NO: 362 - DNA, 463 bp, Homo sapien
acttcatcaggccataatgggtgcctcccgtgagaatccaagcacctttggactgcgcgatgtagatgagccggctgaagatcttgcgcatgcgcggcttcagggcgaagttcttggcgcccccggtcacagaaatgaccaggttgggtgttttcaggtgccagtgctgggtcagcagctcgtaaaggatttccgcgtccgtgtcgcaggacagacgtatatacttccctttcttccccagtgtctcaaactgaatatccccaaaggcgtcggtaggaaattccttggtgtgtttcttgtagttccatttctcactttggttgatctgggtgccttccatgtgctggctctgggcatagccacacttgcacacattctccctgataagcacgatggtgtggacaggaaggaaggatttcattgagcctgcttatggaaactggtattgttagcttaaatagac

SEQ ID NO: 363 - DNA, 653 bp, Homo sapien
  misc_feature (1)...(653): n = A,T,C or G
acccccgagtncctgnctggcatactgngaacgaccaacgacacacccaagctcggcctcctcttggngattctgggtgacatcttcatgaatggcaaccgtgccagwgaggctgtcctctgggaggcactacgcaagatgggactgcgtcctggggtgagacatcctctccttggagatctaacgaaacttctcacctatgagttgtaaagcagaaatacctgnactacagacgagtgcccaacagcaaccccccggaagtatgagttcctctrgggcctccgttcctaccatgagasctagcaagatgnaagtgttgagantcattgcagaggttcagaaaagagacccntcgtgactggtctgcacagttcatggaggctgcagatgaggccttggatgctctggatgctgctgcagctgaggccgaagcccgggctgaagcaagaacccgcatgggaattggagatgaggctgtgtntgggccctggagctgggatgacattgagtttgagctgctgacctgggatgaggaaggagattttggagatccntggtccagaattccatttaccttctgggccagataccaccagaatgcccgctccagattccctcagacctttgccggtcccattattggtcstggtggt

SEQ ID NO: 364 - DNA, 401 bp, Homo sapien
actagaggaaagacgttaaaccactctactaccacttgtggaactctcaaagggtaaatgacaaagccaatgaatgactctaaaaacaatatttacatttaatggtttgtagacaataaaaaaacaaggtggatagatctagaattgtaacattttaagaaaaccatagcatttgacagatgagaaagctcaattatagatgcaaagttataactaaactactatagtagtaaagaaatacatttcacacccttcatataaattcactatcttggcttgaggcactccataaaatgtatcacgtgcatagtaaatctttatatttgctatggcgttgcactagaggacttggactgcaacaagtggatgcgcggaaaatgaaatcttcttcaatagcccag

SEQ ID NO: 365 - DNA, 356 bp, Homo sapien
ccagtgtcatatttgggcttaaaatttcaagaagggcacttcaaatggctttgcatttgcatgtttcagtgctagagcgtaggaatagaccctggcgtccactgtgagatgttcttcagctaccagagcatcaagtctctgcagcaggtcattcttgggtaaagaaatgacttccacaaactctccatcccctggctttggcttcggccttgcgttttcggcatcatctccgttaatggtgactgtcacgatgtgtatagtacagtttgacaagcctgggtccatacagaccgctggagaacattcggcaatgtcccctttgtagccagtttcttcttcgagctcccggagagcag

SEQ ID NO: 366 - DNA, 1851 bp, Homo sapien
tcatcaccattgccagcagcggcaccgttagtcaggttttctgggaatcccacatgagtacttccgtgttcttcattcttcttcaatagccataaatcttctagctctggctggctgttttcacttcctttaagcctttgtgactcttcctctgatgtcagctttaagtcttgttctggattgctgttttcagaagagatttttaacatctgtttttctttgtagtcagaaagtaactggcaaattacatgatgatgactagaaacagcatactctctggccgtctttccagatcttgagaagatacatcaacattttgctcaagtagagggctgactatacttgctgatccacaacatacagcaagtatgagagcagttcttccatatctatccagcgcatttaaattcgcttttttcttgattaaaaatttcaccacttgctgtttttgctcatgtataccaagtagcagtggtgtgaggccatgcttgttttttgattcgatatcagcaccgtataagagcagtgctttggccattaatttatcttcattgtagacagcatagtgtagagtggtatttccatactcatctggaatatttggatcagtgccatgttccagcaacattaacgcacattcatcttcctggcattgtacggcctttgtcagagctgtcctctttttgttgtcaaggacattaagttgacatcgtctgtccagcacgagttttactacttctgaattcccattggcagaggccagatgtagagcagtcctcttttgcttgtccctcttgttcacatccgtgtccctgagcatgacgatgagatcctttctggggactttaccccaccaggcagctctgtggagcttgtccagatcttctccatggacgtggtacctgggatccatgaaggcgctgtcatcgtagtctccccaagcgaccacgttgctcttgccgctcccctgcagcaggggaagcagtggcagcaccacttgcacctcttgctcccaagcgtcttcacagaggagtcgttgtggtctccagaagtgcccacgttgctcttgccgctccccctgtccatccagggaggaagaaatgcaggaaatgaaagatgcatgcacgatggtatactcctcagccatcaaacttctggacagcaggtcacttccagcaaggtggagaaagctgtccacccacagaggatgagatccagaaaccacaatatccattcacaaacaaacacttttcagccagacacaggtactgaaatcatgtcatctgcggcaacatggtggaacctacccaatcacacatcaagagatgaagacactgcagtatatctgcacaacgtaatactcttcatccataacaaaataatataattttcctctggagccatatggatgaactatgaaggaagaactccccgaagaagccagtcgcagagaagccacactgaagctctgtcctcagccatcagcgccacggacaggartgtgtttcttccccagtgatgcagcctcaagttatcccgaagctgccgcagcacacggtggctcctgagaaacaccccagctcttccggtctaacacaggcaagtcaataaatgtgataatcacataaacagaattaaaagcaaagtcacataagcatctcaacagacacagaaaaggcatttgacaaaatccagcatccttgtatttattgttgcagttctcagaggaaatgcttctaacttttccccatttagtattatgttggctgtgggcttgtcataggtggtttttattactttaaggtatgtcccttctatgcctgttttgctgagggttttaattctcgtgcc

SEQ ID NO: 367 - DNA, 668 bp, Homo sapien
cttgagcttccaaatayggaagactggcccttacacasgtcaatgttaaaatgaatgcatttcagtattttgaagataaaattrgtagatctataccttgttttttgattcgatatcagcaccrtataagagcagtgctttggccattaatttatctttcattrtagacagcrtagtgyagagtggtatttccatactcatctggaatatttggatcagtgccatgttccagcaacattaacgcacattcatcttcctggcattgtacggcctgtcagtattagacccaaaaacaaattacatatcttaggaattcaaaataacattccacagctttcaccaactagttatatttaaaggagaaaactcatttttatgccatgtattgaaatcaaacccacctcatgctgatatagttggctactgcatacctttatcagagctgtcctctttttgttgtcaaggacattaagttgacatcgtctgtccagcaggagttttactacttctgaattcccattggcagaggccagatgtagagcagtcctatgagagtgagaagactttttaggaaattgtagtgcactagctacagccatagcaatgattcatgtaactgcaaacactgaatagcctgctattactctgccttcaaaaaaaaaaaaaaa

SEQ ID NO: 368 - DNA, 1512 bp, Homo sapien
gggtcgcccagggggsgcgtgggctttcctcgggtgggtgtgggttttccctgggtggggtgggctgggctrgaatcccctgctggggttggcaggttttggctgggattgacttttytcttcaaacagattggaaacccggagttacctgctagttggtgaaactggttggtagacgcgatctgttggctactactggcttctcctggctgttaaaagcagatggtggttgaggttgattccatgccggctgcttcttctgtgaagaagccatttggtctcaggagcaagatgggcaagtggtgctgccgttgcttcccctgctgcagggagagcggcaagagcaacgtgggcacttctggagaccacgacgactctgctatgaagacactcaggagcaagatgggcaagtggtgccgccactgcttcccctgctgcagggggagtggcaagagcaacgtgggcgcttctggagaccacgacgaytctgctatgaagacactcaggaacaagatgggcaagtggtgctgccactgcttcccctgctgcagggggagcrgcaagagcaaggtgggcgcttggggagactacgatgacagtgccttcatggagcccaggtaccacgtccgtggagaagatctggacaagctccacagagctgcctggtggggtaaagtccccagaaaggatctcatcgtcatgctcagggacactgacgtgaacaagaaggacaagcaaaagaggactgctctacatctggcctctgccaatgggaattcagaagtagtaaaactcstgctggacagacgatgtcaacttaatgtccttgacaacaaaaagaggacagctctgayaaaggccgtacaatgccaggaagatgaatgtgcgttaatgttgctggaacatggcactgatccaaatattccagatgagtatggaaataccactctrcactaygctrtctayaatgaagataaattaatggccaaagcactgctcttatayggtgctgatatcgaatcaaaaaacaaggtatagatctactaattttatcttcaaaatactgaaatgcattcattttaacattgacgtgtgtaagggccagtcttccgtatttggaagctcaagcataacttgaatgaaaatattttgaaatgacctaattatctmagactttattttaaatattgttattttcaaagaagcattagagggtacagttttttttttttaaatgcacttctggtaaatacttttgttgaaaacactgaatttgtaaaaggtaatacttactatttttcaatttttccctcctaggatttttttcccctaatgaatgtaagatggcaaaatttgccctgaaataggttttacatgaaaactccaagaaaagttaaacatgtttcagtgaatagagatcctgctcctttggcaagttcctaaaaaacagtaatagatacgaggtgatgcgcctgtcagtggcaaggtttaagatatttctgatctcgtgcc

SEQ ID NO: 369 - DNA, 1853 bp, Homo sapien
gggtcgcccagggggsgcgtgggctttcctcgggtgggtgtgggttttccctgggtggggtgggctgggctrgaatcccctgctggggttggcaggttttggctgggattgacttttytcttcaaacagattggaaacccggagttacctgctagttggtgaaactggttggtagacgcgatctgttggctactactggcttctcctggctgttaaaagcagatggtggttgaggttgattccatgccggctgcttcttctgtgaagaagccatttggtctcaggagcaagatgggcaagtggtgctgccgttgcttcccctgctgcagggagagcggcaagagcaacgtgggcacttctggagaccacgacgactctgctatgaagacactcaggagcaagatgggcaagtggtgccgccactgcttcccctgctgcagggggagtggcaagagcaacgtgggcgcttctggagaccacgacgaytctgctatgaagacactcaggaacaagatgggcaagtggtgctgccactgcttcccctgctgcagggggagcrgcaagagcaaggtgggcgcttggggagactacgatgacagygccttcatggakcccaggtaccacgtccrtggagaagatctggacaagctccacagagctgcctggtggggtaaagtccccagaaaggatctcatcgtcatgctcagggacackgaygtgaacaagarggacaagcaaaagaggactgctctacatctggcctctgccaatgggaattcagaagtagtaaaactcstgctggacagacgatgtcaacttaatgtccttgacaacaaaaagaggacagctctgayaaaggccgtacaatgccaggaagatgaatgtgcgttaatgttgctggaacatggcactgatccaaatattccagatgagtatggaaataccactctrcactaygctrtctayaatgaagataaattaatggccaaagcactgctcttatayggtgctgatatcgaatcaaaaaacaagcatggcctcacaccactgytacttggtrtacatgagcaaaaacagcaagtsgtgaaatttttaatyaagaaaaaagcgaatttaaaatgcrctggatagatatggaagractgctctcatacttgctgtatgttgtggatcagcaagtatagtcagccytctacttgagcaaaatrttgatgtatcttctcaagatctggaaagacggccagagagtatgctgtttctagtcatcatcatgtaatttgccagttactttctgactacaaagaaaaacagatgttaaaaatctcttctgaaaacagcaatccagaacaagacttaaagctgacatcagaggaagagtcacaaaggcttaaaggaagtgaaaacagccagccagaggcatggaaacttttaaatttaaacttttggtttaatgttttttttttttgccttaataatattagatagtcccaaatgaaatwacctatgagactaggctttgagaatcaatagattctttttttaagaatcttttggctaggagcggtgtctcacgcctgtaattccagcaccttgagaggctgaggtgggcagatcacgagatcaggagatcgagaccatcctggctaacacggtgaaaccccatctctactaaaaatacaaaaacttagctgggtgtggtggcgggtgcctgtagtcccagctactcaggargctgaggcaggagaatggcatgaacccgggaggtggaggttgcagtgagccgagatccgccactacactccagcctgggtgacagagcaagactctgtctcaaaaaaaaaaaaaaaaaaaaa

SEQ ID NO: 370 - DNA, 2184 bp, Homo sapien
ggcacgagaattaaaaccctcagcaaaacaggcatagaagggacataccttaaagtaataaaaaccacctatgacaagcccacagccaacataatactaaatggggaaaagttagaagcatttcctctgagaactgcaacaataaatacaaggatgctggattttgtcaaatgccttttctgtgtctgttgagatgcttatgtgactttgcttttaattctgtttatgtgattatcacatttattgacttgcctgtgttagaccggaagagctggggtgtttctcaggagccaccgtgtgctgcggcagcttcgggataacttgaggctgcatcactggggaagaaacacaytcctgtccgtggcgctgatggctgaggacagagcttcagtgtggcttctctgcgactggcttcttcggggagttcttccttcatagttcatccatatggctccagaggaaaattatattattttgttatggatgaagagtattacgttgtgcagatatactgcagtgtcttcatctcttgatgtgtgattgggtaggttccaccatgttgccgcagatgacatgatttcagtacctgtgtctggctgaaaagtgtttgtttgtgaatggatattgtggtttctggatctcatcctctgtgggtggacagctttctccaccttgctggaagtgacctgctgtccagaagtttgatggctgaggagtataccatcgtgcatgcatctttcatttcctgcatttcttcctccctggatggacagggggagcggcaagagcaacgtgggcacttctggagaccacaacgactcctctgtgaagacgcttgggagcaagaggtgcaagtggtgctgccactgcttcccctgctgcaggggagcggcaagagcaacgtggtcgcttggggagactacgatgacagcgccttcatggatcccaggtaccacgtccatggagaagatctggacaagctccacagagctgcctggtggggtaaagtccccagaaaggatctcatcgtcatgctcagggacacggatgtgaacaagagggacaagcaaaagaggactgctctacatctggcctctgccaatgggaattcagaagtagtaaaactcgtgctggacagacgatgtcaacttaatgtccttgacaacaaaaagaggacagctctgacaaaggccgtacaatgccaggaagatgaatgtgcgttaatgttgctggaacatggcactgatccaaatattccagatgagtatggaaataccactctacactatgctgtctacaatgaagataaattaatggccaaagcactgctcttatacggtgctgatatcgaatcaaaaaacaagcatggcctcacaccactgctacttggtatacatgagcaaaaacagcaagtggtgaaatttttaatcaagaaaaaagcgaatttaaatgcgctggatagatatggaagaactgctctcatacttgctgtatgttgtggatcagcaagtatagtcagccctctacttgagcaaaatgttgatgtatcttctcaagatctggaaagacggccagagagtatgctgtttctagtcatcatcatgtaatttgccagttactttctgactacaaagaaaaacagatgttaaaaatctcttctgaaaacagcaatccagaacaagacttaaagctgacatcagaggaagagtcacaaaggcttaaaggaagtgaaaacagccagccagaggcatggaaacttttaaatttaaacttttggtttaatgttttttttttttgccttaataatattagatagtcccaaatgaaatwacctatgagactaggctttgagaatcaatagattctttttttaagaatcttttggctaggagcggtgtctcacgcctgtaattccagcaccttgagaggctgaggtgggcagatcacgagatcaggagatcgagaccatcctggctaacacggtgaaaccccatctctactaaaaatacaaaaacttagctgggtgtggtggcgggtgcctgtagtcccagctactcaggargctgaggcaggagaatggcatgaacccgggaggtggaggttgcagtgagccgagatccgccactacactccagcctgggtgacagagcaagactctgtctcaaaaaaaaaaaaaaaaaaaaa

SEQ ID NO: 371 - DNA, 1855 bp, Homo sapien
  misc_feature (1)...(1855): n = A,T,C or G
tgcacgcatcggccagtgtctgtgccacgtacactgacgccccctgagatgtgcacgccgcacgcgcacgttgcacgcgcggcagcggcttggctggcttgtaacggcttgcacgcgcacgccgcccccgcataaccgtcagactggcctgtaacggcttgcaggcgcacgccgcacgcgcgtaacggcttggctgccctgtaacggcttgcacgtgcatgctgcacgcgcgttaacggcttggctggcatgtagccgcttggcttggctttgcattytttgctkggctkggcgttgktytcttggattgacgcttcctccttggatkgacgtttcctccttggatkgacgtttcytytytcgcgttcctttgctggacttgaccttttytctgctgggtttggcattcctttggggtgggctgggtgttttctccgggggggktkgcccttcctggggtgggcgtgggkcgcccccagggggcgtgggctttccccgggtgggtgtgggttttcctggggtggggtgggctgtgctgggatccccctgctggggttggcagggattgacttttttcttcaaacagattggaaacccggagtaacntgctagttggtgaaactggttggtagacgcgatctgctggtactactgtttctcctggctgttaaaagcagatggtggctgaggttgattcaatgccggctgcttcttctgtgaagaagccatttggtctcaggagcaagatgggcaagtggtgcgccactgcttcccctgctgcagggggagcggcaagagcaacgtgggcacttctggagaccacaacgactcctctgtgaagacgcttgggagcaagaggtgcaagtggtgctgcccactgcttcccctgctgcaggggagcggcaagagcaacgtggkcgcttggggagactacgatgacagcgccttcatggakcccaggtaccacgtccrtggagaagatctggacaagctccacagagctgcctggtggggtaaagtccccagaaaggatctcatcgtcatgctcagggacactgaygtgaacaagarggacaagcaaaagaggactgctctacatctggcctctgccaatgggaattcagaagtagtaaaactcgtgctggacagacgatgtcaacttaatgtccttgacaacaaaaagaggacagctctgacaaaggccgtacaatgccaggaagatgaatgtgcgttaatgttgctggaacatggcactgatccaaatattccagatgagtatggaaataccactctacactatgctgtctacaatgaagataaattaatggccaaagcactgctcttatacggtgctgatatcgaatcaaaaaacaaggtatagatctactaattttatcttcaaaatactgaaatgcattcattttaacattgacgtgtgtaagggccagtcttccgtatttggaagctcaagcataacttgaatgaaaatattttgaaatgacctaattatctaagactttattttaaatattgttattttcaaagaagcattagagggtacagttttttttttttaaatgcacttctggtaaatacttttgttgaaaacactgaatttgtaaaaggtaatacttactatttttcaatttttccctcctaggatttttttcccctaatgaatgtaagatggcaaaatttgccctgaaataggttttacatgaaaactccaagaaaagttaaacatgtttcagtgaatagagatcctgctcctttggcaagttcctaaaaaacagtaatagatacgaggtgatgcgcctgtcagtggcaaggtttaagatatttctgatctcgtgcc

SEQ ID NO: 372 - DNA, 1059 bp, Homo sapien
gcaacgtgggcacttctggagaccacaacgactcctctgtgaagacgcttgggagcaagaggtgcaagtggtgctgcccactgcttcccctgctgcaggggagcggcaagagcaacgtgggcgcttgrggagactmcgatgacagygccttcatggagcccaggtaccacgtccgtggagaagatctggacaagctccacagagctgccctggtggggtaaagtccccagaaaggatctcatcgtcatgctcagggacactgaygtgaacaagarggacaagcaaaagaggactgctctacatctggcctctgccaatgggaattcagaagtagtaaaactcstgctggacagacgatgtcaacttaatgtccttgacaacaaaaagaggacagctctgayaaaggccgtacaatgccaggaagatgaatgtgcgttaatgttgctggaacatggcactgatccaaatattccagatgagtatggaaataccactctrcactaygctrtctayaatgaagataaattaatggccaaagcactgctcttatayggtgctgatatcgaatcaaaaaacaaggtatagatctactaattttatcttcaaaatactgaaatgcattcattttaacattgacgtgtgtaagggccagtcttccgtatttggaagctcaagcataacttgaatgaaaatattttgaaatgacctaattatctaagactttattttaaatattgttattttcaaagaagcattagagggtacagttttttttttttaaatgcacttctggtaaatacttttgttgaaaacactgaatttgtaaaaggtaatacttactatttttcaatttttccctcctaggatttttttcccctaatgaatgtaagatggcaaaatttgccctgaaataggttttacatgaaaactccaagaaaagttaaacatgtttcagtgaatagagatcctgctcctttggcaagttcctaaaaaacagtaatagatacgaggtgatgcgcctgtcagtggcaaggtttaagatatttctgatctcgtgcc

SEQ ID NO: 373 - DNA, 1155 bp, Homo sapien
atggtggttgaggttgattccatgccggctgcctcttctgtgaagaagccatttggtctcaggagcaagatgggcaagtggtgctgccgttgcttcccctgctgcagggagagcggcaagagcaacgtgggcacttctggagaccacgacgactctgctatgaagacactcaggagcaagatgggcaagtggtgccgccactgcttcccctgctgcagggggagtggcaagagcaacgtgggcgcttctggagaccacgacgactctgctatgaagacactcaggaacaagatgggcaagtggtgctgccactgcttcccctgctgcagggggagcggcaagagcaaggtgggcgcttggggagactacgatgacagtgccttcatggagcccaggtaccacgtccgtggagaagatctggacaagctccacagagctgcctggtggggtaaagtccccagaaaggatctcatcgtcatgctcagggacactgacgtgaacaagaaggacaagcaaaagaggactgctctacatctggcctctgccaatgggaattcagaagtagtaaaactcctgctggacagacgatgtcaacttaatgtccttgacaacaaaaagaggacagctctgataaaggccgtacaatgccaggaagatgaatgtgcgttaatgttgctggaacatggcactgatccaaatattccagatgagtatggaaataccactctgcactacgctatctataatgaagataaattaatggccaaagcactgctcttatatggtgctgatatcgaatcaaaaaacaagcatggcctcacaccactgttacttggtgtacatgagcaaaaacagcaagtcgtgaaatttttaatcaagaaaaaagcgaatttaaatgcactggatagatatggaaggactgctctcatacttgctgtatgttgtggatcagcaagtatagtcagccttctacttgagcaaaatattgatgtatcttctcaagatctatctggacagacggccagagagtatgctgtttctagtcatcatcatgtaatttgccagttactttctgactacaaagaaaaacagatgctaaaaatctcttctgaaaacagcaatccagaaaatgtctcaagaaccagaaataaataa

SEQ ID NO: 374 - DNA, 2000 bp, Homo sapien
atggtggttgaggttgattccatgccggctgcctcttctgtgaagaagccatttggtctcaggagcaagatgggcaagtggtgctgccgttgcttcccctgctgcagggagagcggcaagagcaacgtgggcacttctggagaccacgacgactctgctatgaagacactcaggagcaagatgggcaagtggtgccgccactgcttcccctgctgcagggggagtggcaagagcaacgtgggcgcttctggagaccacgacgactctgctatgaagacactcaggaacaagatgggcaagtggtgctgccactgcttcccctgctgcagggggagcggcaagagcaaggtgggcgcttggggagactacgatgacagtgccttcatggagcccaggtaccacgtccgtggagaagatctggacaagctccacagagctgcctggtggggtaaagtccccagaaaggatctcatcgtcatgctcagggacactgacgtgaacaagaaggacaagcaaaagaggactgctctacatctggcctctgccaatgggaattcagaagtagtaaaactcctgctggacagacgatgtcaacttaatgtccttgacaacaaaaagaggacagctctgataaaggccgtacaatgccaggaagatgaatgtgcgttaatgttgctggaacatggcactgatccaaatattccagatgagtatggaaataccactctgcactacgctatctataatgaagataaattaatggccaaagcactgctcttatatggtgctgatatcgaatcaaaaaacaagcatggcctcacaccactgttacttggtgtacatgagcaaaaacagcaagtcgtgaaatttttaatcaagaaaaaagcgaatttaaatgcactggatagatatggaaggactgctctcatacttgctgtatgttgtggatcagcaagtatagtcagccttctacttgagcaaaatattgatgtatcttctcaagatctatctggacagacggccagagagtatgctgtttctagtcatcatcatgtaatttgccagttactttctgactacaaagaaaaacagatgctaaaaatctcttctgaaaacagcaatccagaacaagacttaaagctgacatcagaggaagagtcacaaaggttcaaaggcagtgaaaatagccagccagagaaaatgtctcaagaaccagaaataaataaggatggtgatagagaggttgaagaagaaatgaagaagcatgaaagtaataatgtgggattactagaaaacctgactaatggtgtcactgctggcaatggtgataatggattaattcctcaaaggaagagcagaacacctgaaaatcagcaatttcctgacaacgaaagtgaagagtatcacagaatttgcgaattagtttctgactacaaagaaaaacagatgccaaaatactcttctgaaaacagcaacccagaacaagacttaaagctgacatcagaggaagagtcacaaaggcttgagggcagtgaaaatggccagccagagctagaaaattttatggctatcgaagaaatgaagaagcacggaagtactcatgtcggattcccagaaaacctgactaatggtgccactgctggcaatggtgatgatggattaattcctccaaggaagagcagaacacctgaaagccagcaatttcctgacactgagaatgaagagtatcacagtgacgaacaaaatgatactcagaagcaattttgtgaagaacagaacactggaatattacacgatgagattctgattcatgaagaaaagcagatagaagtggttgaaaaaatgaattctgagctttctcttagttgtaagaaagaaaaagacatcttgcatgaaaatagtacgttgcgggaagaaattgccatgctaagactggagctagacacaatgaaacatcagagccagctaaaaaaaaaaaaaaaaaaaaaaaaaaaaaaaaa

SEQ ID NO: 375 - DNA, 2040 bp, Homo sapien
atggtggttgaggttgattccatgccggctgcctcttctgtgaagaagccatttggtctcaggagcaagatgggcaagtggtgctgccgttgcttcccctgctgcagggagagcggcaagagcaacgtgggcacttctggagaccacgacgactctgctatgaagacactcaggagcaagatgggcaagtggtgccgccactgcttcccctgctgcagggggagtggcaagagcaacgtgggcgcttctggagaccacgacgactctgctatgaagacactcaggaacaagatgggcaagtggtgctgccactgcttcccctgctgcagggggagcggcaagagcaaggtgggcgcttggggagactacgatgacagtgccttcatggagcccaggtaccacgtccgtggagaagatctggacaagctccacagagctgcctggtggggtaaagtccccagaaaggatctcatcgtcatgctcagggacactgacgtgaacaagaaggacaagcaaaagaggactgctctacatctggcctctgccaatgggaattcagaagtagtaaaactcctgctggacagacgatgtcaacttaatgtccttgacaacaaaaagaggacagctctgataaaggccgtacaatgccaggaagatgaatgtgcgttaatgttgctggaacatggcactgatccaaatattccagatgagtatggaaataccactctgcactacgctatctataatgaagataaattaatggccaaagcactgctcttatatggtgctgatatcgaatcaaaaaacaagcatggcctcacaccactgttacttggtgtacatgagcaaaaacagcaagtcgtgaaatttttaatcaagaaaaaagcgaatttaaatgcactggatagatatggaaggactgctctcatacttgctgtatgttgtggatcagcaagtatagtcagccttctacttgagcaaaatattgatgtatcttctcaagatctatctggacagacggccagagagtatgctgtttctagtcatcatcatgtaatttgccagttactttctgactacaaagaaaaacagatgctaaaaatctcttctgaaaacagcaatccagaacaagacttaaagctgacatcagaggaagagtcacaaaggttcaaaggcagtgaaaatagccagccagagaaaatgtctcaagaaccagaaataaataaggatggtgatagagaggttgaagaagaaatgaagaagcatgaaagtaataatgtgggattactagaaaacctgactaatggtgtcactgctggcaatggtgataatggattaattcctcaaaggaagagcagaacacctgaaaatcagcaatttcctgacaacgaaagtgaagagtatcacagaatttgcgaattagtttctgactacaaagaaaaacagatgccaaaatactcttctgaaaacagcaacccagaacaagacttaaagctgacatcagaggaagagtcacaaaggcttgagggcagtgaaaatggccagccagagaaaagatctcaagaaccagaaataaataaggatggtgatagagagctagaaaattttatggctatcgaagaaatgaagaagcacggaagtactcatgtcggattcccagaaaacctgactaatggtgccactgctggcaatggtgatgatggattaattcctccaaggaagagcagaacacctgaaagccagcaatttcctgacactgagaatgaagagtatcacagtgacgaacaaaatgatactcagaagcaattttgtgaagaacagaacactggaatattacacgatgagattctgattcatgaagaaaagcagatagaagtggttgaaaaaatgaattctgagctttctcttagttgtaagaaagaaaaagacatcttgcatgaaaatagtacgttgcgggaagaaattgccatgctaagactggagctagacacaatgaaacatcagagccagctaaaaaaaaaaaaaaaaaaaaaaaaaaaa

SEQ ID NO: 376 - protein, 329 aa, Homo sapien
MDIVVSGSHPLWVDSFLHLAGSDLLSRSLMAEEYTIVHASFISCISSSLDGQGERQEQRGHFWRPQRLLCEDAWEQEVQVVLPLLPLLQGSGKSNVVAWGDYDDSAFMDPRYHVHGEDLDKLHRAAWWGKVPRKDLIVMLRDTDVNKRDKQKRTALHLASANGNSEVVKLVLDRRCQLNVLDNKKRTALTKAVQCQEDECALMLLEHGTDPNIPDEYGNTTLHYAVYNEDKLMAKALLLYGADIESKNKHGLTPLLLGIHEQKQQVVKFLIKKKANLNALDRYGRTALILAVCCGSASIVSPLLEQNVDVSSQDLERRPESMLFLVIIM

SEQ ID NO: 377 - protein, 148 aa, Homo sapien
  VARIANT (1)...(148): Xaa = Any Amino Acid
MTXPSWSPGTTSVEKIWTSSTELPWWGKVPRKDLIVMLRDTDVNKXDKQKRTALHLASANGNSEVVKLXLDRRCQLNVLDNKKRTALXKAVQCQEDECALMLLEHGTDPNIPDEYGNTTLHYAXYNEDKLMAKALLLYGADIESKNKV

SEQ ID NO: 378 - protein, 1719 aa, Homo sapien [sequence omitted]

SEQ ID NO: 379 - protein, 656 aa, Homo sapien
MVVEVDSMPAASSVKKPFGLRSKMGKWCCRCFPCCRESGKSNVGTSGDHDDSAMKTLRSKMGKWCRHCFPCCRGSGKSNVGASGDHDDSAMKTLRNKMGKWCCHCFPCCRGSGKSKVGAWGDYDDSAFMEPRYHVRGEDLDKLHRAAWWGKVPRKDLIVMLRDTDVNKKDKQKRTALHLASANGNSEVVKLLLDRRCQLNVLDNKKRTALIKAVQCQEDECALMLLEHGTDPNIPDEYGNTTLHYAIYNEDKLMAKALLLYGADIESKNKHGLTPLLLGVHEQKQQVVKFLIKKKANLNALDRYGRTALILAVCCGSASIVSLLLEQNIDVSSQDLSGQTAREYAVSSHHHVICQLLSDYKEKQMLKISSENSNPEQDLKLTSEEESQRFKGSENSQPEKMSQEPEINKDGDREVEEEMKKHESNNVGLLENLTNGVTAGNGDNGLIPQRKSRTPENQQFPDNESEEYHRICELVSDYKEKQMPKYSSENSNPEQDLKLTSEEESQRLEGSENGQPELENFMAIEEMKKHGSTHVGFPENLTNGATAGNGDDGLIPPRKSRTPESQQFPDTENEEYHSDEQNDTQKQFCEEQNTGILHDEILIHEEKQIEVVEKMNSELSLSCKKEKDILHENSTLREEIAMLRLELDTMKHQSQL

SEQ ID NO: 380 - protein, 671 aa, Homo sapien
MVVEVDSMPAASSVKKPFGLRSKMGKWCCRCFPCCRESGKSNVGTSGDHDDSAMKTLRSKMGKWCRHCFPCCRGSGKSNVGASGDHDDSAMKTLRNKMGKWCCHCFPCCRGSGKSKVGAWGDYDDSAFMEPRYHVRGEDLDKLHRAAWWGKVPRKDLIVMLRDTDVNKKDKQKRTALHLASANGNSEVVKLLLDRRCQLNVLDNKKRTALIKAVQCQEDECALMLLEHGTDPNIPDEYGNTTLHYAIYNEDKLMAKALLLYGADIESKNKHGLTPLLLGVHEQKQQVVKFLIKKKANLNALDRYGRTALILAVCCGSASIVSLLLEQNIDVSSQDLSGQTAREYAVSSHHHVICQLLSDYKEKQMLKISSENSNPEQDLKLTSEEESQRFKGSENSQPEKMSQEPEINKDGDREVEEEMKKHESNNVGLLENLTNGVTAGNGDNGLIPQRKSRTPENQQFPDNESEEYHRICELVSDYKEKQMPKYSSENSNPEQDLKLTSEEESQRLEGSENGQPEKRSQEPEINKDGDRELENFMAIEEMKKHGSTHVGFPENLTNGATAGNGDDGLIPPRKSRTPESQQFPDTENEEYHSDEQNDTQKQFCEEQNTGILHDEILIHEEKQIEVVEKMNSELSLSCKKEKDILHENSTLREEIAMLRLELDTMKHQSQL

SEQ ID NO: 381 - DNA, 251 bp, Homo sapien
ggagaagcgtctgctggggcaggaaggggtttccctgccctctcacctgtccctcaccaaggtaacatgcttcccctaagggtatcccaacccaggggcctcaccatgacctctgaggggccaatatcccaggagaagcattggggagttgggggcaggtgaaggacccaggactcacacatcctgggcctccaaggcagaggagagggtcctcaagaaggtcaggaggaaaatccgtaacaagcagtcag

SEQ ID NO: 382 - DNA, 3279 bp, Homo sapiens
cttcctgcagcccccatgctggtgaggggcacgggcaggaacagtggacccaacatggaaatgctggagggtgtcaggaagtgatcgggctctggggcagggaggaggggtggggagtgtcactgggaggggacatcctgcagaaggtaggagtgagcaaacacccgctgcaggggaggggagagccctgcggcacctgggggagcagagggagcagcacctgcccaggcctgggaggaggggcctggagggcgtgaggaggagcgagggggctgcatggctggagtgagggatcaggggcagggcgcgagatggcctcacacagggaagagagggcccctcctgcagggcctcacctgggccacaggaggacactgcttttcctctgaggagtcaggagctgtggatggtgctggacagaagaaggacagggcctggctcaggtgtccagaggctgtcgctggcttccctttgggatcagactgcagggagggagggcggcagggttgtggggggagtgacgatgaggatgacctgggggtggctccaggccttgcccctgcctgggccctcacccagcctccctcacagtctcctggccctcagtctctcccctccactccatcctccatctggcctcagtgggtcattctgatcactgaactgaccatacccagccctgcccacggccctccatggctccccaatgccctggagaggggacatctagtcagagagtagtcctgaagaggtggcctctgcgatgtgcctgtgggggcagcatcctgcagatggtcccggccctcatcctgctgacctgtctgcagggactgtcctcctggaccttgccccttgtgcaggagctggaccctgaagtcccctccccataggccaagactggagccttgttccctctgttggactccctgcccatattcttgtgggagtgggttctggagacatttctgtctgttcctgagagctgggaattgctctcagtcatctgcctgcgcggttctgagagatggagttgcctaggcagttattggggccaatctttctcactgtgtctctcctcctttacccttagggtgattctgggggtccacttgtctgtaatggtgtgcttcaaggtatcacatcatggggccctgagccatgtgccctgcctgaaaagcctgctgtgtacaccaaggtggtgcattaccggaagtggatcaaggacaccatcgcagccaacccctgagtgcccctgtcccacccctacctctagtaaatttaagtccacctcacgttctggcatcacttggcctttctggatgctggacacctgaagcttggaactcacctggccgaagctcgagcctcctgagtcctactgacctgtgctttctggtgtggagtccagggctgctaggaaaaggaatgggcagacacaggtgtatgccaatgtttctgaaatgggtataatttcgtcctctccttcggaacactggctgtctctgaagacttctcgctcagtttcagtgaggacacacacaaagacgtgggtgaccatgttgtttgtggggtgcagagatgggaggggtggggcccaccctggaagagtggacagtgacacaaggtggacactctctacagatcactgaggataagctggagccacaatgcatgaggcacacacacagcaaggttgacgctgtaaacatagcccacgctgtcctgggggcactgggaagcctagataaggccgtgagcagaaagaaggggaggatcctcctatgttgttgaaggagggactagggggagaaactgaaagctgattaattacaggaggtttgttcaggtcccccaaaccaccgtcagatttgatgatttcctagcaggacttacagaaataaagagctatcatgctgtggtttattatggtttgttacattgataggatacatactgaaatcagcaaacaaaacagatgtatagattagagtgtggagaaaacagaggaaaacttgcagttacgaagactggcaacttggctttactaagttttcagactggcaggaagtcaaacctattaggctgaggaccttgtggagtgtagctgatccagctgatagaggaactagccaggtgggggcctttccctttggatggggggcatatccgacagttattctctccaagtggagacttacggacagcatataattctccctgcaaggatgtatgataatatgtacaaagtaattccaactgaggaagctcacctgatccttagtgtccagggtttttactgggggtctgtaggacgagtatggagtacttgaataattgacctgaagtcctcagacctgaggttccctagagttcaaacagatacagcatggtccagagtcccagatgtacaaaaacagggattcatcacaaatcccatctttagcatgaagggtctggcatggcccaaggccccaagtatatcaaggcacttgggcagaacatgccaaggaatcaaatgtcatctcccaggagttattcaagggtgagccctttacttgggatgtacaggctttgagcagtgcagggctgctgagtcaaccttttattgtacaggggatgagggaaagggagaggatgaggaagcccccctggggatttggtttggtcttgtgatcaggtggtctatggggctatccctacaaagaagaatccagaaataggggcacattgaggaatgatactgagcccaaagagcattcaatcattgttttatttgccttcttttcacaccattggtgagggagggattaccaccctggggttatgaagatggttgaacaccccacacatagcaccggagatatgagatcaacagtttcttagccatagagattcacagcccagagcaggaggacgctgcacaccatgcaggatgacatgggggatgcgctcgggattggtgtgaagaagcaaggactgttagaggcaggctttatagtaacaagacggtggggcaaactctgatttccgtgggggaatgtcatggtcttgctttactaagttttgagactggcaggtagtgaaactcattaggctgagaaccttgtggaatgcagctgacccagctgatagaggaagtagccaggtgggagcctttcccagtgggtgtgggacatatctggcaagattttgtggcactcctggttacagatactggggcagcaaataaaactgaatcttgttttcagaccttaaaaaaaaaaaaaaaaaaaaagtttt

SEQ ID NO: 383 - protein, 154 aa, Homo sapiens [sequence omitted]

SEQ ID NO: 384 - DNA, 557 bp, Homo sapiens
ggatcctctagagcggccgcctactactactaaattcgcggccgcgtcgacgaagaagagaaagatgtgttttgttttggactctctgtggtcccttccaatgctgtgggtttccaaccaggggaagggtcccttttgcattgccaagtgccataaccatgagcactactctaccatggttctgcctcctggccaagcaggctggtttgcaagaatgaaatgaatgattctacagctaggacttaaccttgaaatggaaagtcttgcaatcccatttgcaggatccgtctgtgcacatgcctctgtagagagcagcattcccagggaccttggaaacagttggcactgtaaggtgcttgctccccaagacacatcctaaaaggtgttgtaatggtgaaaacgtcttccttctttattgccccttcttatttatgtgaacaactgtttgtctttttttgtatcttttttaaactgtaaagttcaattgtgaaaatgaatatcatgcaaataaattatgcgatttttttttcaaagtaaaaaaaaaaaaaaaaaaaaaa

SEQ ID NO: 385 - DNA, 337 bp, Homo sapiens
ttcccaggtgatgtgcgagggaagacacatttactatccttgatggggctgattcctttagtttctctagcagcagatgggttaggaggaagtgacccaagtggttgactcctatgtgcatctcaaagccatctgctgtcttcgagtacggacacatcatcactcctgcattgttgatcaaaacgtggaggtgcttttcctcagctaagaagcccttagcaaaagctcgaatagacttagtatcagacaggtccagtttccgcaccaacacctgctggttccctgtcgtggtctggatctctttggccaccaattcccccttttccacatcccggca

SEQ ID NO: 386 - DNA, 300 bp, Homo sapiens
gggcccgctaccggcccaggccccgcctcgcgagtcctcctccccgggtgcctgcccgcagcccgctcggcccagagggtgggcgcggggctgcctctaccggctggcggctgtaactcagcgaccttggcccgaaggctctagcaaggacccaccgaccccagccgcggcggcggcggcgcggactttgcccggtgtgtggggcggagcggactgcgtgtccgcggacgggcagcgaagatgttagccttcgctgccaggaccgtggaccgatcccagggctgtggtgtaacctcagcc

SEQ ID NO: 387 - DNA, 537 bp, Homo sapiens
gggccgagtcgggcaccaagggactctttgcaggcttccttcctcggatcatcaaggctgccccctcctgtgccatcatgatcagcacctatgagttcggcaaaagcttcttccagaggctgaaccaggaccggcttctgggcggctgaaaggggcaaggaggcaaggaccccgtctctcccacggatggggagagggcaggaggagacccagccaagtgccttttcctcagcactgagggagggggcttgtttcccttccctcccggcgacaagctccagggcagggctgtccctctgggcggcccagcacttcctcagacacaacttcttcctgctgctccagtcgtggggatcatcacttacccaccccccaagttcaagaccaaatcttccagctgcccccttcgtgtttccctgtgtttgctgtagctgggcatgtctccaggaaccaagaagccctcagcctggtgtagtctccctgacccttgttaattccttaagtctaaagatgatgaacttcaaaaaaaaaaaaaaa

SEQ ID NO: 388 - DNA, 520 bp, Homo sapiens
aggataatttttaaaccaatcaaatgaaaaaaacaaacaaacaaaaaaggaaatgtcatgtgaggttaaaccagtttgcattcccctaatgtggaaaaagtaagaggactactcagcactgtttgaagattgcctcttctacagcttctgagaattgtgttatttcacttgccaagtgaaggaccccctccccaacatgccccagcccacccctaagcatggtcccttgtcaccaggcaaccaggaaactgctacttgtggacctcaccagagaccaggagggtttggttagctcacaggacttcccccaccccagaagattagcatcccatactagactcatactcaactcaactaggctcatactcaattgatggttattagacaattccatttctttctggttattataaacagaaaatctttcctcttctcattaccagtaaaggctcttggtatctttctgttggaatgatttctatgaacttgtcttattttaatggtgggttttttttctggt

SEQ ID NO: 389 - DNA, 365 bp, Homo sapiens
cgttgccccagtttgacagaaggaaaggcggagcttattcaaagtctagagggagtggaggagttaaggctggatttcagatctgcctggttccagccgcagtgtgccctctgctcccccaacgactttccaaataatctcaccagcgccttccagctcaggcgtcctagaagcgtcttgaagcctatggccagctgtctttgtgttccctctcacccgcctgtcctcacagctgagactcccaggaaaccttcagactaccttcctctgccttcagcaaggggcgttgcccacattctctgagggtcagtggaagaacctagactcccattgctagaggtagaaaggggaagggtgctggggag

SEQ ID NO: 390 - DNA, 221 bp, Homo sapiens
  misc_feature (1)...(221): n = A,T,C or G
tgcctctccatcctggccccgacttctctgtcaggaaagtggggatggaccccatctgcatacacggnttctcatgggtgtggaacatctctgcttgcggtttcaggaaggcctctggctgctctangagtctgancngantcgttgccccantntgacanaaggaaaggcggagcttattcaaagtctagagggagtggaggagttaaggctggatttca

SEQ ID NO: 391 - DNA, 325 bp, Homo sapiens
  misc_feature (1)...(325): n = A,T,C or G
tggagcaggtcccgaggcctccctagagcctggggccgactctgtgncgatgcangctttctctcgcgcccagcctggagctgctcctggcatctaccaacaatcagncgaggcgagcagtagccagggcactgctgccaacagccagtccnnataccatcatgtnacccggtgngctctnaanttngatntccanagccctacccatcntagttctgctctcccaccggntaccagccccactgcccaggaatcctacagccagtaccctgtcccgacgtctctacctaccagtacgatgagacctccggctactactatgacc

SEQ ID NO: 392 - DNA, 277 bp, Homo sapiens
  misc_feature (1)...(277): n = A,T,C or G
atattgtttaactccttcctttatatcttttaacattttcatggngaaaggttcacatctagtctcacttnggcnagngnctcctacttgagtctcttccccggcctgnnccagtngnaaantaccangaaccgncatgncttaanaacnncctggtttntgggttnntcaatgactgcatgcagtgcaccaccctgtccactacgtgatgctgtaggattaaagtctcacagtgggcggctgaggatacagcgccgcgtcctgtgttgctggggaa

SEQ ID NO: 393 - DNA, 566 bp, Homo sapiens
actagtccagtgtggtggaattcgcggccgcgtcgacggacaggtcagctgtctggctcagtgatctacattctgaagttgtctgaaaatgtcttcatgattaaattcagcctaaacgttttgccgggaacactgcagagacaatgctgtgagtttccaaccttagcccatctgcgggcagagaaggtctagtttgtccatcagcattatcatgatatcaggactggttacttggttaaggaggggtctaggagatctgtcccttttagagacaccttacttataatgaagtatttgggagggtggttttcaaaagtagaaatgtcctgtattccgatgatcatcctgtaaacattttatcatttattaatcatccctgcctgtgtctattattatattcatatctctacgctggaaactttctgcctcaatgtttactgtgcctttgtttttgctagtttgtgttgttgaaaaaaaaaacattctctgcctgagttttaatttttgtccaaagttattttaatctatacaattaaaagcttttgcctatcaaaaaaaaaaaaaaa

SEQ ID NO: 394 - DNA, 384 bp, Homo sapiens
  misc_feature (1)...(384): n = A,T,C or G
gaacatacatgtcccggcacctgagctgcagtctgacatcatcgccatcacgggcctcgctgcaaattnggaccgggccaaggctggactgctggagcgtgtgaaggagctacaggccnagcaggaggaccgggctttaaggagttttaagctgagtgtcactgtagaccccaaataccatcccaagattatcgggagaaagggggcagtaattacccaaatccggttggagcatgacgtgaacatccagtttcctgataaggacgatgggaaccagccccaggaccaaattaccatcacagggtacgaaaagaacacagaagctgccagggatgctatactgagaattgtgggtgaacttgagcagatggtttctgaggacgt

SEQ ID NO: 395 - DNA, 399 bp, Homo sapiens
ggcaaaactgtgtgacctcaataagacctcgcagatccaaggtcaagtatcagaagtgactctgaccttggactccaagacctacatcaacagcctggctatattagatgatgagccagttatcagaggtttcatcattgcggaaattgtggagtctaaggaaatcatggcctctgaagtattcacgtctttccagtaccctgagttctctatagagttgcctaacacaggcagaattggccagctacttgtctgcaattgtatcttcaagaataccctggccatccctttgactgacgtcaagttctctttggaaagcctgggcatctcctcactacagacctctgaccatgggacggtgcagcctggtgagaccatccaatcccaaataaaatgcac

SEQ ID NO: 396 - DNA, 403 bp, Homo sapiens
  misc_feature (1)...(403): n = A,T,C or G
tggagttntcagtgcaaacaagccataaagcttcagtagcaaattactgtctcacagaaagacattttcaacttctgctccagctgctgataaaacaaatcatgtgtttagcttgactccagacaaggacaacctgttccttcataactctctagagaaaaaaaggagttgttagtagatactaaaaaaagtggatgaataatctggatatttttcctaaaaagattccttgaaacacattaggaaaatggagggccttatgatcagaatgctagaattagtccattgtgctgaagcagggtttaggggagggagtgagggataaaagaaggaaaaaaagaagagtgagaaaacctatttatcaaagcaggtgctatcactcaatgttaggccctgctctttt

SEQ ID NO: 397 - DNA, 100 bp, Homo sapiens
  misc_feature (1)...(100): n = A,T,C or G
actagtncagtgtggtggaattcgcggccgcgtcgacctanaanccatctctatagcaaatccatccccgctcctggttggtnacagaatgactgacaaa

SEQ ID NO: 398 - DNA, 278 bp, Homo sapiens
  misc_feature (1)...(278): n = A,T,C or G
gcggccgcgtcgacagcagttccgccagcgctcgcccctgggtggggatgtgctgcacgcccacctggacatctggaagtcagcggcctggatgaaagagcggacttcacctggggcgattcactactgtgcctcgaccagtgaggagagctggaccgacagcgaggtggactcatcatgctccgggcagcccatccacctgtggcagttcctcaaggagttgctactcaagccccacagctatggccgcttcattangtggctcaacaaggagaagg

SEQ ID NO: 399 - DNA, 298 bp, Homo sapiens
  misc_feature (1)...(298): n = A,T,C or G
acggaggtggaggaagcgnccctgggatcganaggatgggtcctgncattgaccncctcnggggtgccngcatggagcgcatgggcgcgggcctgggccacggcatggatcgcgtgggctccgagatcgagcgcatgggcctggtcatggaccgcatgggctccgtggagcgcatgggctccggcattgagcgcatgggcccgctgggcctcgaccacatggcctccancattgancgcatgggccagaccatggagcgcattggctctggcgtggagcncatgggtgccggcatggg

SEQ ID NO: 400 - DNA, 548 bp, Homo sapiens
acatcaactacttcctcattttaaggtatggcagttcccttcatccccttttcctgccttgtacatgtacatgtatgaaatttccttctcttaccgaactctctccacacatcacaaggtcaaagaaccacacgcttagaagggtaagagggcaccctatgaaatgaaatggtgatttcttgagtctcttttttccacgtttaaggggccatggcaggacttagagttgcgagttaagactgcagagggctagagaattatttcatacaggctttgaggccacccatgtcacttatcccgtataccctctcaccatccccttgtctactctgatgcccccaagatgcaactgggcagctagttggccccataattctgggcctttgttgtttgttttaattacttgggcatcccaggaagctttccagtgatctcctaccatgggcccccctcctgggatcaagcccctcccaggccctgtccccagcccctcctgccccagcccacccgcttgccttggtgctcagccctcccattgggagcaggtt

SEQ ID NO: 401 - DNA, 355 bp, Homo sapiens
  misc_feature (1)...(355): n = A,T,C or G
actgtttccatgttatgtttctacacattgctacctcagtgctcctggaaacttagcttttgatgtctccaagtagtccaccttcatttaactctttgaaactgtatcatctttgccaagtaagagtggtggcctatttcagctgctttgacaaaatgactggctcctgacttaacgttctataaatgaatgtgctgaagcaaagtgcccatggtggcggcgaagaaganaaagatgtgttttgttttggactctctgtggtcccttccaatgctgngggtttccaaccaggggaagggtcccttttgcattgccaagtgccataaccatgagcactactctaccatggntctgc

SEQ ID NO: 402 - DNA, 407 bp, Homo sapiens
  misc_feature (1)...(407): n = A,T,C or G
atggggcaagctggataaagaaccaagacccactggagtatgctgtcttcaagaaacccatctcacatgcggtggcatacataggctcaaaataaaggaatggagaaaaatatttcaagcaaatggaaaacagaaaaaagcaggtgttgcactcctactttctgacaaaacagactatgcgaataaagataaaaaagagaaggacattacaaaggtggtcctgacctttgataaatctcattgcttgataccaacctgggctgttttaattgcccaaaccaaaaggataatttgctgaggttgtggagcttctcccctgcagagagtccctgatctcccaaaatttggttgagatgtaaggntgattttgctgacaactccttttctgaagttttactcatttccaa

SEQ ID NO: 403 - DNA, 303 bp, Homo sapiens
  misc_feature (1)...(303): n = A,T,C or G
cagtatttatagccnaactgaaaagctagtagcaggcaagtctcaaatccaggcaccaaatcctaagcaagagccatggcatggtgaaaatgcaaaaggagagtctggccaatctacaaatagagaacaagacctactcagtcatgaacaaaaaggcagacaccaacatggatctcatgggggattggatattgtaattatagagcaggaagatgacagtgatcgtcatttggcacaacatcttaacaacgaccgaaacccattatttacataaacctccattcggtaaccatgttgaaagga

SEQ ID NO: 404 - DNA, 225 bp, Homo sapiens
aagtgtaacttttaaaaatttagtggattttgaaaattcttagaggaaagtaaaggaaaaattgttaatgcactcatttacctttacatggtgaaagttctctcttgatcctacaaacagacattttccactcgtgtttccatagttgttaagtgtatcagatgtgttgggcatgtgaatctccaagtgcctgtgtaataaataaagtatctttatttcattcat

SEQ ID NO: 405 - DNA, 334 bp, Homo sapiens
  misc_feature (1)...(334): n = A,T,C or G
gagctgttatactgtgagttctactaggaaatcatcaaatctgagggttgtctggaggacttcaatacacctccccccatagtgaatcagcttccagggggtccagtccctctccttacttcatccccatcccatgccaaaggaagaccctccctccttggctcacagccttctctaggcttcccagtgcctccaggacagagtgggttatgttttcagctccatccttgctgtgagtgtctggtgcggttgtgcctccagcttctgctcagtgcttcatggacagtgtccagcccatgtcactctccactctctcanngtggatcccacccct

SEQ ID NO: 406 - DNA, 216 bp, Homo sapiens
  misc_feature (1)...(216): n = A,T,C or G
tttcatacctaatgagggagttganatnacatnnaaccaggaaatgcatggatctcaanggaaacaaacacccaataaactcggagtggcagactgacaactgtgagacatgcacttgctacnaaacacaaatttnatgttgcacccttgtttctacacctgtgggttatgacaaagacaactgccaaagaatnttcaagaaggaggactgccant

SEQ ID NO: 407 - DNA, 413 bp, Homo sapiens
gctgacttgctagtatcatctgcattcattgaagcacaagaacttcatgccttgactcatgtaaatgcaataggattaaaaaataaatttgatatcacatggaaacagacaaaaaatattgtacaacattgcacccagtgtcagattctacacctggccactcaggaagcaagagttaatcccagaggtctatgtcctaatgtgttatggcaaatggatgtcatgcacgtaccttcatttggaaaattgtcatttgtccatgtgacagttgatacttattcacatttcatatgggcaacctgccagacaggagaaagtcttcccatgttaaaagacatttattatcttgttttcctgtcatgggagttccagaaaaagttaaaacagacaatgggccaggttctgtagtaaag

SEQ ID NO: 408 - DNA, 183 bp, Homo sapiens
  misc_feature (1)...(183): n = A,T,C or G
ggagctngccctcaattcctccatntctatgttancatatttaatgtcttttgnnattaatncttaactagttaatccttaaagggctanntaatccttaactagtccctccattgtgagcattatccttccagtattcnccttctnttttatttactccttcctggctacccatgtactntt

SEQ ID NO: 409 - DNA, 250 bp, Homo sapiens
  misc_feature (1)...(250): n = A,T,C or G
cccacgcatgataagctctttatttctgtaagtcctgctaggaaatcatcaaatctgacggtggtttgggggacctgaacaaacctcctgtaattaatcagctttcagtttctccccctagtccctccttcaacaacataggaggatcctccccttctttctgctcacggccttatctaggcttcccagtgcccccaggacagcgtgggctatgtttacagcgcntccttgctgggggggggccntatgc

SEQ ID NO: 410 - DNA, 306 bp, Homo sapiens
  misc_feature (1)...(306): n = A,T,C or G
ggctggtttgcaagaatgaaatgaatgattctacagctaggacttaaccttgaaatggaaagtcttgcaatcccatttgcaggatccgtctgtgcacatgcctctgtagagagcagcattcccagggaccttggaaacagttggcactgtaaggtgcttgctccccaagacacatcctaaaaggtgttgtaatggtgaaaaccgcttccttctttattgccccttcttatttatgtgaacnactggttggctttttttgnatcttttttaaactggaaagttcaattgngaaaatgaatatcntgc

SEQ ID NO: 411 - DNA, 261 bp, Homo sapiens
  misc_feature (1)...(261): n = A,T,C or G
agagatattncttaggtnaaagttcatagagttcccatgaactatatgactggccacacaggatcttttgtatttaaggattctgagattttgcttgagcaggattagataaggctgttctttaaatgtctgaaatggaacagatttcaaaaaaaaaccccacaatctagggtgggaacaaggaaggaaagatgtgaataggctgatgggcaaaaaaccaatttacccatcagttccagccttctctcaaggngaggcaaa

SEQ ID NO: 412 - DNA, 241 bp, Homo sapiens
  misc_feature (1)...(241): n = A,T,C or G
gttcaatgttacctgacatttctacaacaccccactcaccgatgtattcgttgcccagtgggaacataccagcctgaatttggaaaaaataattgtgtttcttgcccaggaaatactacgactgactttgatggctccacaaacataacccagtgtaaaaacagaagatgtggaggggagctgggagatttcactgggtacattgaattcccaaactacccangcaattacccagccaaca

SEQ ID NO: 413 - DNA, 231 bp, Homo sapiens
  misc_feature (1)...(231): n = A,T,C or G
aactcttacaatccaagtgactcatctgtgtgcttgaatcctttccactgtctcatctccctcatccaagtttctagtaccttctctttgttgtgaaggataatcaaactgaacaacaaaaagtttactctcctcatttggaacctaaaaactctcttcttcctgggtctgagggctccaagaatccttgaatcanttctcagatcattggggacaccanatcaggaacct

SEQ ID NO: 414 - DNA, 234 bp, Homo sapiens
actgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctcca

SEQ ID NO: 415 - DNA, 217 bp, Homo sapiens
  misc_feature (1)...(217): n = A,T,C or G
gcataggattaagactgagtatcttttctacattcttttaactttctaaggggcacttctcaaaacacagaccaggtagcaaatctccactgctctaaggntctcaccaccactttctcacacctagcaatagtagaattcagtcctacttctgaggccagaagaatggttcagaaaaatantggattataaaaaataacaattaagaaaaataatc

SEQ ID NO: 416 - DNA, 213 bp, Homo sapiens
  misc_feature (1)...(213): n = A,T,C or G
atgcatatntaaagganactgcctcgcttttagaagacatctggnctgctctctgcatgaggcacagcagtaaagctctttgattcccagaatcaagaactctccccttcagactattaccgaatgcaaggtggttaattgaaggccactaattgatgctcaaatagaaggatattgactatattggaacagatggagtctctactacaaaag

SEQ ID NO: 417 - DNA, 303 bp, Homo sapiens
  misc_feature (1)...(303): n = A,T,C or G
nagtcttcaggcccatcagggaagttcacactggagagaagtcatacatatgtactgtatgtgggaaaggctttactctgagttcaaatcttcaagcccatcagagagtccacactggagagaagccatacaaatgcaatgagtgtgggaagagcttcaggagggattcccattatcaagttcatctagtggtccacacaggagagaaaccctataaatgtgagatatgtgggaagggcttcantcaaagttcgtatcttcaaatccatcngaaggnccacagtatananaaaccttttaagt

SEQ ID NO: 418 - DNA, 328 bp, Homo sapiens
  misc_feature (1)...(328): n = A,T,C or G
tttttggcggtggtggggcagggacgggacangagtctcactctgttgcccaggctggagtgcacaggcatgatctcggctcactacaacccctgcctcccatgtccaagcgattcttgtgcctcagccttccctgtagctagaattacaggcacatgccaccacacccagctagtttttgtatttttagtagagacagggtttcaccatgttggccaggctggtctcaaactcctnacctcagnggtcaggctggtctcaaactcctgacctcaagtgatctgcccacctcagcctcccaaagtgctangattacaggccgtgagcc

SEQ ID NO: 419 - DNA, 389 bp, Homo sapiens
  misc_feature (1)...(389): n = A,T,C or G
cctcctcaagacggcctgtggtccgcctcccggcaaccaagaagcctgcagtgccatatgacccctgagccatggactggagcctgaaaggcagcgtacaccctgctcctgatcttgctgcttgtttcctctctgtggctccattcatagcacagttgttgcactgaggcttgtgcaggccgagcaaggccaagctggctcaaagagcaaccagtcaactctgccacggtgtgccaggcaccggttctccagccaccaacctcactcgctcccgcaaatggcacatcagttcttctaccctaaaggtaggaccaaagggcatctgcttttctgaagtcctctgctctatcagccatcacgtggcagccactcnggctgtgtcgacgcgg

SEQ ID NO: 420 - DNA, 408 bp, Homo sapiens
gttcctcctaactcctgccagaaacagctctcctcaacatgagagctgcacccctcctcctggccagggcagcaagccttagccttggcttcttgtttctgctttttttctggctagaccgaagtgtactagccaaggagttgaagtttgtgactttggtgtttcggcatggagaccgaagtcccattgacacctttcccactgaccccataaaggaatcctcatggccacaaggatttggccaactcacccagctgggcatggagcagcattatgaacttggagagtatataagaaagagatatagaaaattcttgaatgagtcctataaacatgaacaggtttatattcgaagcacagacgttgaccggactttgatgaagtgctatgacaaacctggcaagcccg

SEQ ID NO: 421 - DNA, 352 bp, Homo sapiens
  misc_feature (1)...(352): n = A,T,C or G
gctcaaaaatctttttactgatnggcatggctacacaatcattgactattacggaggccagaggagaatgaggcctggcctgggagccctgtgcctactanaagcacattagattatccattcactgacagaacaggtcttttttgggtccttcttctccaccacnatatacttgcagtcctccttcttgaagattctttggcagttgtctttgtcataacccacaggtgtagaaacaagggtgcaacatgaaatttctgtttcgtagcaagtgcatgtctcacaagttggcangtctgccactccgagtttattgggtgtttgtttcctttgagatccatgcatttcctgg

SEQ ID NO: 422 - DNA, 337 bp, Homo sapiens
atgccaccatgctggcaatgcagcgggcggtcgaaggcctgcatatccagcccaagctggcgatgatcgacggcaaccgttgcccgaagttgccgatgccagccgaagcggtggtcaagggcgatagcaaggtgccggcgatcgcggcggcgtcaatcctggccaaggtcagccgtgatcgtgaaatggcagctgtcgaattgatctacccgggttatggcatcggcgggcataagggctatccgacaccggtgcacctggaagccttgcagcggctggggccgacgccgattcaccgacgcttcttccgccggtacggctggcctatgaaaattat

SEQ ID NO: 423 - DNA, 310 bp, Homo sapiens
  misc_feature (1)...(310): n = A,T,C or G
gctcaaaaatctttttactgatatggcatggctacacaatcattgactattagaggccagaggagaatgaggcctggcctgggagccctgtgcctactanaagcncattagattatccattcactgacagaacaggtcttttttgggtccttcttctccaccacgatatacttgcagtcctccttcttgaagattctttggcagttgtctttgtcataacccacaggtgtanaaacaagggtgcaacatgaaatttctgtttcgtagcaagtgcatgtctcacagttgtcaagtctgccctccgagttta

SEQ ID NO: 424 - DNA, 370 bp, Homo sapiens
  misc_feature (1)...(370): n = A,T,C or G
gctcaaaaatctttttactgataggcatggctacacaatcattgactattagaggccagaggagaatgaggcctggcctgggagccctgtgcctactagaagcacattagattatccattcactgacagaacaggtcttttttgggtccttcttctccaccacgatatacttgcagtcctccttcttgaagattctttggcagttgtctttgtcataacccacaggtgtagaaacatcctggttgaatctcctggaactccctcattaggtatgaaatagcatgatgcattgcataaagtcacgaaggtggcaaagatcacaacgctgcccagganaacattcattgtgataagcaggactccgtcgacg

SEQ ID NO: 425 - DNA, 216 bp, Homo sapiens
  misc_feature (1)...(216): n = A,T,C or G
aattgctatnntttattttgccactcaaaataattaccaaaaaaaaaaaatnttaaatgataacaacncaacatcaaggnaaananaacaggaatggntgactntgcataaatnggccgaanattatccattatnttaagggttgacttcaggntacagcacacagacaaacatgcccaggaggntntcaggaccgctcgatgtnttntgaggagg

SEQ ID NO: 426 - DNA, 596 bp, Homo sapiens
cttccagtgaggataaccctgttgccccgggccgaggttctccattaggctctgattgattggcagtcagtgatggaagggtgttctgatcattccgactgccccaagggtcgctggccagctctctgttttgctgagttggcagtaggacctaatttgttaattaagagtagatggtgagctgtccttgtattttgattaacctaatggccttcccagcacgactcggattcagctggagacatcacggcaacttttaatgaaatgatttgaagggccattaagaggcacttcccgttattaggcagttcatctgcactgataacttcttggcagctgagctggtcggagctgtggcccaaacgcacacttggcttttggttttgagatacaactcttaatcttttagtcatgcttgagggtggatggccttttcagctttaacccaatttgcactgccttggaagtgtagccaggagaatacactcatatactcgtgggcttagaggccacagcagatgtcattggtctactgcctgagtcccgctggtcccatcccaggaccttccatcggcgagtacctgggagcccgtgct

SEQ ID NO: 427 - DNA, 107 bp, Homo sapiens
  misc_feature (1)...(107): n = A,T,C or G
gaagaattcaagttaggtttattcaaagggcttacngagaatcctanacccaggncccagcccgggagcagccttanagagctcctgtttgactgcccggctcagng

SEQ ID NO: 428 - DNA, 38 bp, Homo sapiens
  misc_feature (1)...(38): n = A,T,C or G
gaacttccnaanaangactttattcactattttacatt

SEQ ID NO: 429 - DNA, 544 bp, Homo sapiens
ctttgctggacggaataaaagtggacgcaagcatgacctcctgatgagggcgctgcatttattgaagagcggctgcagccctgcggttcagattaaaatccgagaattgtatagacgccgatatccacgaactcttgaaggactttctgatttatccacaatcaaatcatcggttttcagtttggatggtggctcatcacctgtagaacctgacttggccgtggctggaatccactcgttgccttccacttcagttacacctcactcaccatcctctcctgttggttctgtgctgcttcaagatactaagcccacatttgagatgcagcagccatctcccccaattcctcctgtccatcctgatgtgcagttaaaaaatctgcccttttatgatgtccttgatgttctcatcaagcccacgagtttagttcaaagcagtattcagcgatttcaagagaagttttttatttttgctttgacacctcaacaagttagagagatatgcatatccagggattttttgccaggtggtaggagagattat

SEQ ID NO: 430 - DNA, 507 bp, Homo sapiens
  misc_feature (1)...(507): n = A,T,C or G
cttatcncaatggggctcccaaacttggctgtgcagtggaaactccgggggaattttgaagaacactgacacccatcttccaccccgacactctgatttaattgggctgcagtgagaacagagcatcaatttaaaaagctgcccagaatgttntcctgggcagcgttgtgatctttgccnccttcgtgactttatgcaatgcatcatgctatttcatacctaatgagggagttccaggagattcaaccaggatgtttctacncctgtgggttatgacaaagacaactgccaaagaatnttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaagatttttgagcaaaaaaaaaaaaaaaaaaa

SEQ ID NO: 431 - DNA, 392 bp, Homo sapiens
  misc_feature (1)...(392): n = A,T,C or G
gaaaattcagaatggataaaaacaaatgaagtacaaaatatttcagatttacatagcgataaacaagaaagcacttatcaggaggacttacaaatggaagtacactctanaaccatcatctatcatggctaaatgtgagattagcacagctgtattatttgtacattgcaaacacctagaaagagatgggaaacaaaatcccaggagttttgtgtgtggagtcctgggttttccaacagacatcattccagcattctgagattagggngattggggatcattctggagttggaatgttcaacaaaagtgatgttgttaggtaaaatgtacaacttctggatctatgcagacattgaaggtgcaatgagtctggcttttactctgctgtttct

SEQ ID NO: 432 - DNA, 387 bp, Homo sapiens
  misc_feature (1)...(387): n = A,T,C or G
ggtatccntacataatcaaatatagctgtagtacatgttttcattggngtagattaccacaaatgcaaggcaacatgtgtagatctcttgtcttattcttttgtctataatactgtattgngtagtccaagctctcggnagtccagccactgngaaacatgctccctttagattaacctcgtggacnctnttgttgnattgtctgaactgtagngccctgtattttgcttctgtctgngaattctgttgcttctggggcatttccttgngatgcagaggaccaccacacagatgacagcaatctgaattgntccaatcacagctgcgattaagacatactgaaatcgtacaggaccgggaacaacgtatagaacactggagtccttt

SEQ ID NO: 433 - DNA, 281 bp, Homo sapiens
  misc_feature (1)...(281): n = A,T,C or G
ttcaactagcanagaanactgcttcagggngtgtaaaatgaaaggcttccacgcagttatctgattaaagaacactaagagagggacaaggctagaagccgcaggatgtctacactatagcaggcnctatttgggttggctggaggagctgtggaaaacatggagagattggcgctggagatcgccgtggctattcctcnttgntattacaccagngaggntctctgtntgcccactggttnnaaaaccgntatacaataatgatagaataggacacacat

SEQ ID NO: 434 - DNA, 484 bp, Homo sapiens
ttttaaaataagcatttagtgctcagtccctactgagtactctttctctcccctcctctgaatttaattctttcaacttgcaatttgcaaggattacacatttcactgtgatgtatattgtgttgcaaaaaaaaaaaagtgtctttgtttaaaattacttggtttgtgaatccatcttgctttttccccattggaactagtcattaacccatctctgaactggtagaaaaacatctgaagagctagtctatcagcatctgacaggtgaattggatggttctcagaaccatttcacccagacagcctgtttctatcctgtttaataaattagtttgggttctctacatgcataacaaaccctgctccaatctgtcacataaaagtctgtgacttgaagtttagtcagcacccccaccaaactttatttttctatgtgttttttgcaacatatgagtgttttgaaaataaagtacccatgtcttta

SEQ ID NO: 435 - DNA, 424 bp, Homo sapiens
gcgccgctcagagcaggtcactttctgccttccacgtcctccttcaaggaagccccatgtgggtagctttcaatatcgcaggttcttactcctctgcctctataagctcaaacccaccaacgatcgggcaagtaaaccccctccctcgccgacttcggaactggcgagagttcagcgcagatgggcctgtggggagggggcaagatagatgagggggagcggcatggtgcggggtgaccccttggagagaggaaaaaggccacaagaggggctgccaccgccactaacggagatggccctggtagagacctttgggggtctggaacctctggactccccatgctctaactcccacactctgctatcagaaacttaaacttgaggattttctctgtttttcactcgcaataaattcagagcaaac

SEQ ID NO: 436 - DNA, 667 bp, Homo sapiens
  misc_feature (1)...(667): n = A,T,C or G
accttgggaanactctcacaatataaagggtcgtagactttactccaaattccaaaaaggtcctggccatgtaatcctgaaagttttcccaaggtagctataaaatccttataagggtgcagcctcttctggaattcctctgatttcaaagtctcactctcaagttcttgaaaacgagggcagttcctgaaaggcaggtatagcaactgatcttcagaaagaggaactgtgtgcaccgggatgggctgccagagtaggataggattccagatgctgacaccttctgggggaaacagggctgccaggtttgtcatagcactcatcaaagtccggtcaacgtctgtgcttcgaatataaacctgttcatgtttataggactcattcaagaattttctatatctctttcttatatactctccaagttcataatgctgctccatgcccagctgggtgagttggccaaatccttgtggccatgaggattcctttatggggtcagtgggaaaggtgtcaatgggacttcggtctccatgccgaaacaccaaagtcacaaacttcaactccttggctagtacacttcggtctagccagaaaaaaagcagaaacaagaagccaaggctaaggcttgctgccctgccaggaggaggggtgcagctctcatgttgag

SEQ ID NO: 437 - DNA, 693 bp, Homo sapiens
ctacgtctcaaccctcatttttaggtaaggaatcttaagtccaaagatattaagtgactcacacagccaggtaaggaaagctggattggcacactaggactctaccataccgggttttgttaaagctcaggttaggaggctgataagcttggaaggaacttcagacagctttttcagatcataaaagataattcttagcccatgttcttctccagagcagacctgaaatgacagcacagcaggtactcctctattttcacccctcttgcttctactctctggcagtcagacctgtgggaggccatgggagaaagcagctctctggatgtttgtacagatcatggactattctctgtggaccatttctccaggttaccctaggtgtcactattggggggacagccagcatctttagctttcatttgagtttctgtctgtcttcagtagaggaaacttttgctcttcacacttcacatctgaacacctaactgctgttgctcctgaggtggtgaaagacagatatagagcttacagtatttatcctatttctaggcactgagggctgtggggtaccttgtggtgccaaaacagatcctgttttaaggacatgttgcttcagagatgtctgtaactatctgggggctctgttggctctttaccctgcatcatgtgctctcttggctgaaaatgacc

SEQ ID NO: 438 - DNA, 360 bp, Homo sapiens
ctgcttatcacaatgaatgttctcctgggcagcgttgtgatctttgccaccttcgtgactttatgcaatgcatcatgctatttcatacctaatgagggagttccaggagattcaaccaggatgtttctacacctgtgggttatgacaaagacaactgccaaagaatcttcaagaaggaggactgcaagtatatctggtggagaagaaggacccaaaaaagacctgttctgtcagtgaatggataatctaatgtgcttctagtaggcacagggctcccaggccaggcctcattctcctctggcctctaatagtcaataattgtgtagccatgcctatcagtaaaaagatttttgagcaaac

SEQ ID NO: 439 - DNA, 431 bp, Homo sapiens
  misc_feature (1)...(431): n = A,T,C or G
gttcctnntaactcctgccagaaacagctctcctcaacatgagagctgcacccctcctcctggccagggcagcaagccttagccttggcttcttgtttctgctttttttctggctagaccgaagtgtactagccaaggagttgaagtttgtgactttggtgtttcggcatggagaccgaagtcccattgacacctttcccactgaccccataaaggaatcctcatggccacaaggatttggccaactcacccagctgggcatggagcagcattatgaacttggagagtatataagaaagagatatagaaaattcttgaatgagtcctataaacatgaacaggtttatattcgaagcacagacgttgaccggactttgatgagtgctatgacaaacctggcagcccgtcgacgcggccgcgaatttagtagt

SEQ ID NO: 440 - DNA, 523 bp, Homo sapiens
agagataaagcttaggtcaaagttcatagagttcccatgaactatatgactggccacacaggatcttttgtatttaaggattctgagattttgcttgagcaggattagataaggctgttctttaaatgtctgaaatggaacagatttcaaaaaaaaaccccacaatctagggtgggaacaaggaaggaaagatgtgaataggctgatgggcaaaaaaccaatttacccatcagttccagccttctctcaaggagaggcaaagaaaggagatacagtggagacatctggaaagttttctccactggaaaactgctactatctgtttttatatttctgttaaaatatatgaggctacagaactaaaaattaaaacctctttgtgtcccttggtcctggaacatttatgttccttttaaagaaacaaaaatcaaactttacagaaagatttgatgtatgtaatacatatagcagctcttgaagtatatatatcatagcaaataagtcatctgatgagaacaagcta

SEQ ID NO: 441 - DNA, 430 bp, Homo sapiens
gttcctcctaactcctgccagaaacagctctcctcaacatgagagctgcacccctcctcctggccagggcagcaagccttagccttggcttcttgtttctgctttttttctggctagaccgaagtgtactagccaaggagttgaagtttgtgactttggtgtttcggcatggagaccgaagtcccattgacacctttcccactgaccccataaaggaatcctcatggccacaaggatttggccaactcacccagctgggcatggagcagcattatgaacttggagagtatataagaaagagatatagaaaattcttgaatgagtcctataaacatgaacaggtttatattcgaagcacagacgttgaccggactttgatgagtgctatgacaaacctggcagcccgtcgacgcggccgcgaatttagtag

SEQ ID NO: 442 - DNA, 362 bp, Homo sapiens
ctaaggaattagtagtgttcccatcacttgtttggagtgtgctattctaaaagattttgatttcctggaatgacaattatattttaactttggtgggggaaagagttataggaccacagtcttcacttctgatacttgtaaattaatcttttattgcacttgttttgaccattaagctatatgtttagaaatggtcattttacggaaaaattagaaaaattctgataatagtgcagaataaatgaattaatgttttacttaatttatattgaactgtcaatgacaaataaaaattctttttgattattttttgttttcatttaccagaataaaaactaagaattaaaagtttgattacagtc

SEQ ID NO: 443 - DNA, 624 bp, Homo sapiens
  misc_feature (1)...(624): n = A,T,C or G
ttttttttttgcaacacaatatacatcacagtgaaatgtgtaatccttgcaaattgcaagttgaaagaattaaattcagaggaggggagagaaagagtactcagtagggactgagcactaaatgcttattttaaaagaaatgtaaagagcagaaagcaattcaggctaccctgccttttgtgctggctagtactccggtcggtgtcagcagcacgtggcattgaacattgcaatgtggagcccaaaccacagaaaatggggtgaaattggccaactttctattaacttggcttcctgttttataaaatattgtgaataatatcacctacttcaaagggcagttatgaggcttaaatgaactaacgcctacaaaacacttaaacatagataacataggtgcaagtactatgtatctggtacatggtaaacatccttattattaaagtcaacgctaaaatgaatgtgtgtgcatatgctaatagtacagagagagggcacttaaaccaactaagggcctggagggaaggtttcctggaaagangatgcttgtgctgggtccaaatcttggtctactatgaccttggccaaattatttaaactttgtccctatctgctaaacagatc

SEQ ID NO: 444 - DNA, 425 bp, Homo sapiens
  misc_feature (1)...(425): n = A,T,C or G
gcacatcattnntcttgcattctttgagaataagaagatcagtaaatagttcagaagtgggaagctttgtccaggcctgtgtgtgaacccaatgttttgcttagaaatagaacaagtaagttcattgctatagcataacacaaaatttgcataagtggtggtcagcaaatccttgaatgctgcttaatgtgagaggttggtaaaatcctttgtgcaacactctaactccctgaatgttttgctgtgctgggacctgtgcatgccagacaaggccaagctggctgaaagagcaaccagccacctctgcaatctgccacctcctgctggcaggatttgtttttgcatcctgtgaagagccaaggaggcaccagggcataagtgagtagacttatggtcgacgcggccgcgaatttagtagtagtaga

SEQ ID NO: 445 - DNA, 414 bp, Homo sapiens
  misc_feature (1)...(414): n = A,T,C or G
catgtttatgnttttggattactttgggcacctagtgtttctaaatcgtctatcattcttttctgtttttcaaaagcagagatggccagagtctcaacaaactgtatcttcaagtctttgtgaaattctttgcatgtggcagattattggatgtagtttcctttaactagcatataaatctggtgtgtttcagataaatgaacagcaaaatgtggtggaattaccatttggaacattgtgaatgaaaaattgtgtctctagattatgtaacaaataactatttcctaaccattgatctttggatttttataatcctactcacaaatgactaggcttctcctcttgtattttgaagcagtgtgggtgctggattgataaaaaaaaaaaaagtcgacgcggccgcgaatttagtag

SEQ ID NO: 446 - DNA, 631 bp, Homo sapiens
  misc_feature (1)...(631): n = A,T,C or G
acaaattagaanaaagtgccagagaacaccacataccttgtccggaacattacaatggcttctgcatgcatgggaagtgtgagcattctatcaatatgcaggagccatcttgcaggtgtgatgctggttatactggacaacactgtgaaaaaaaggactacagtgttctatacgttgttcccggtcctgtacgatttcagtatgtcttaatcgcagctgtgattggaacaattcagattgctgtcatctgtgtggtggtcctctgcatcacaagggccaaactttaggtaatagcattggactgagatttgtaaactttccaaccttccaggaaatgccccagaagcaacagaattcacagacagaagcaaaatacagggcactacagttcagacaatacaacaagagcgtccacgaggttaatctaaagggagcatgtttcacagtggctggactaccgagagcttggactacacaatacagtattatagacaaaagaataagacaagagatctacacatgttgccttgcatttgtggtaatctacaccaatgaaaacatgtactacagctatatttgattatgtatggatatatttgaaatagtatacattgtcttgatgttttttctg

SEQ ID NO: 447 - DNA, 585 bp, Homo sapiens
  misc_feature (1)...(585): n = A,T,C or G
ccttgggaaaantntcacaatataaagggtcgtagactttactccaaattccaaaaaggtcctggccatgtaatcctgaaagttttcccaaggtagctataaaatccttataagggtgcagcctcttctggaattcctctgatttcaaagtctcactctcaagttcttgaaaacgagggcagttcctgaaaggcaggtatagcaactgatcttcagaaagaggaactgtgtgcaccgggatgggctgccagagtaggataggattccagatgctgacaccttctgggggaaacagggctgccaggtttgtcatagcactcatcaaagtccggtcaacgtctgtgcttcgaatataaacctgttcatgtttataggactcattcaagaattttctatatctctttcttatatactctccaagttcataatgctgctccatgcccagctgggtgagttggccaaatccttgtggccatgaggattcctttatggggtcagtgggaaaggtgtcaatgggacttcggtctccatgccgaaacaccaaagtcacaaacttcaactccttggctagtacacttcggtcta

SEQ ID NO: 448 - DNA, 93 bp, Homo sapiens
  misc_feature (1)...(93): n = A,T,C or G
tgctcgtgggtcattctgannnccgaactgaccntgccagccctgccgangggccnccatggctccctagtgccctggagagganggggctag

SEQ ID NO: 449 - DNA, 706 bp, Homo sapiens
  misc_feature (1)...(706): n = A,T,C or G
ccaagttcatgctntgtgctggacgctggacagggggcaaaagcnnttgctcgtgggtcattctgancaccgaactgaccatgccagccctgccgatggtcctccatggctccctagtgccctggagaggaggtgtctagtcagagagtagtcctggaaggtggcctctgngaggagccacggggacagcatcctgcagatggtcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcncgacgttgtaaaacgacggccagtgaattgaatttaggtgacnctatagaagagctatgacgtcgcatgcacgcgtacgtaagcttggatcctctagagcggccgcctactactactaaattcgcggccgcgtcgacgtgggatccncactgagagagtggagagtgacatgtgctggacnctgtccatgaagcactgagcagaagctggaggcacaacgcnccagacactcacagctactcaggaggctgagaacaggttgaacctgggaggtggaggttgcaatgagctgagatcaggccnctgcnccccagcatggatgacagagtgaaactccatcttaaaaaaaaaaaaaaaaa

SEQ ID NO: 450 - DNA, 493 bp, Homo sapiens
gagacggagtgtcactctgttgcccaggctggagtgcagcaagacactgtctaagaaaaaacagttttaaaaggtaaaacaacataaaaagaaatatcctatagtggaaataagagagtcaaatgaggctgagaactttacaaagggatcttacagacatgtcgccaatatcactgcatgagcctaagtataagaacaacctttggggagaaaccatcatttgacagtgaggtacaattccaagtcaggtagtgaaatgggtggaattaaactcaaattaatcctgccagctgaaacgcaagagacactgtcagagagttaaaaagtgagttctatccatgaggtgattccacagtcttctcaagtcaacacatctgtgaactcacagaccaagttcttaaaccactgttcaaactctgctacacatcagaatcacctggagagctttacaaactcccattgccgagggtcgacgcggccgcgaatttagtag

SEQ ID NO: 451 - DNA, 501 bp, Homo sapiens
  misc_feature (1)...(501): n = A,T,C or G
gggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcncgacgttgtaaaacgacggccagtgaattgaatttaggtgacnctatagaagagctatgacgtcgcatgcacgcgtacgtaagcttggatcctctagagcggccgcctactactactaaattcgcggccgcgtcgacgtgggatccncactgagagagtggagagtgacatgtgctggacnctgtccatgaagcactgagcagaagctggaggcacaacgcnccagacactcacagctactcaggaggctgagaacaggttgaacctgggaggtggaggttgcaatgagctgagatcaggccnctgcnccccagcatggatgacagagtgaaactccatcttaaaaaaaaaaaaaaaaa

SEQ ID NO: 452 - DNA, 51 bp, Homo sapiens
  misc_feature (1)...(51): n = A,T,C or G
agacggtttcaccnttacaacnccttttaggatgggnnttggggagcaagc

SEQ ID NO: 453 - DNA, 317 bp, Homo sapiens
  misc_feature (1)...(317): n = A,T,C or G
tacatcttgctttttccccattggaactagtcattaacccatctctgaactggtagaaaaacatctgaagagctagtctatcagcatctggcaagtgaattggatggttctcagaaccatttcacccanacagcctgtttctatcctgtttaataaattagtttgggttctctacatgcataacaaaccctgctccaatctgtcacataaaagtctgtgacttgaagtttantcagcacccccaccaaactttatttttctatgtgttttttgcaacatatgagtgttttgaaaataaggtacccatgtctttatta

SEQ ID NO: 454 - DNA, 231 bp, Homo sapiens
ttcgaggtacaatcaactctcagagtgtagtttccttctatagatgagtcagcattaatataagccacgccacgctcttgaaggagtcttgaattctcctctgctcactcagtagaaccaagaagaccaaattcttctgcatcccagcttgcaaacaaaattgttcttctaggtctccacccttcctttttcagtgttccaaagctcctcacaatttcatgaacaacagct

SEQ ID NO: 455 - DNA, 231 bp, Homo sapiens
taccaaagagggcataataatcagtctcacagtagggttcaccatcctccaagtgaaaaacattgttccgaatgggctttccacaggctacacacacaaaacaggaaacatgccaagtttgtttcaacgcattgatgacttctccaaggatcttcctttggcatcgaccacattcaggggcaaagaatttctcatagcacagctcacaatacagggctcctttctcctcta

SEQ ID NO: 456 - DNA, 231 bp, Homo sapiens
ttggcaggtacccttacaaagaagacaccataccttatgcgttattaggtggaataatcattccattcagtattatcgttattattcttggagaaaccctgtctgtttactgtaaccttttgcactcaaattcctttatcaggaataactacatagccactatttacaaagccattggaacctttttatttggtgcagctgctagtcagtccctgactgacattgccaagt

SEQ ID NO: 457 - DNA, 231 bp, Homo sapiens
  misc_feature (1)...(231): n = A,T,C or G
cgaggtacccaggggtctgaaaatctctnntttantagtcgatagcaaaattgttcatcagcattccttaatatgatcttgctataattagatttttctccattagagttcatacagttttatttgattttattagcaatctctttcagaagacccttgagatcattaagctttgtatccagttgtctaaatcgatgcctcatttcctctgaggtgtcgctggcttttgtg

SEQ ID NO: 458 - DNA, 231 bp, Homo sapiens
aggtctggttccccccacttccactcccctctactctctctaggactgggctgggccaagagaagaggggtggttagggaagccgttgagacctgaagccccaccctctaccttccttcaacaccctaaccttgggtaacagcatttggaattatcatttgggatgagtagaatttccaaggtcctgggttaggcattttggggggccagaccccaggagaagaagattct

SEQ ID NO: 459 - DNA, 231 bp, Homo sapiens
ggtaccgaggctcgctgacacagagaaaccccaacgcgaggaaaggaatggccagccacaccttcgcgaaacctgtggtggcccaccagtcctaacgggacaggacagagagacagagcagccctgcactgttttccctccaccacagccatcctgtccctcattggctctgtgctttccactatacacagtcaccgtcccaatgagaaacaagaaggagcaccctccaca

SEQ ID NO: 460 - DNA, 231 bp, Homo sapiens
gcaggtataacatgctgcaacaacagatgtgactaggaacggccggtgacatggggagggcctatcaccctattcttgggggctgcttcttcacagtgatcatgaagcctagcagcaaatcccacctccccacacgcacacggccagcctggagcccacagaagggtcctcctgcagccagtggagcttggtccagcctccagtccacccctaccaggcttaaggatagaa

SEQ ID NO: 461 - DNA, 231 bp, Homo sapiens
cgaggtttgagaagctctaatgtgcaggggagccgagaagcaggcggcctagggagggtcgcgtgtgctccagaagagtgtgtgcatgccagaggggaaacaggcgcctgtgtgtcctgggtggggttcagtgaggagtgggaaattggttcagcagaaccaagccgttgggtgaataagagggggattccatggcactgatagagccctatagtttcagagctgggaatt

SEQ ID NO: 462 - DNA, 231 bp, Homo sapiens
aggtaccctcattgtagccatgggaaaattgatgttcagtggggatcagtgaattaaatggggtcatgcaagtataaaaattaaaaaaaaaagacttcatgcccaatctcatatgatgtggaagaactgttagagagaccaacagggtagtgggttagagatttccagagtcttacattttctagaggaggtatttaatttcttctcactcatccagtgttgtatttagga

SEQ ID NO: 463 - DNA, 231 bp, Homo sapiens
tactccagcctggtgacagagcgagaccctatcaccgccccccaccccaccaaaaaaaaaactgagtagacaggtgtcctcttggcatggtaagtcttaagtcccctcccagatctgtgacatttgacaggtgtcttttcctctggacctcggtgtccccatctgagtgagaaaaggcagtggggaggtggatcttccagtcgaagcggtatagaagcccgtgtgaaaagc

SEQ ID NO: 464 - DNA, 231 bp, Homo sapiens
gtactctaagattttatctaagttgccttttctgggtgggaaagtttaaccttagtgactaaggacatcacatatgaagaatgtttaagttggaggtggcaacgtgaattgcaaacagggcctgcttcagtgactgtgtgcctgtagtcccagctactcgggagtctgtgtgaggccaggggtgccagcgcaccagctagatgctctgtaacttctaggccccattttccc

SEQ ID NO: 465 - DNA, 231 bp, Homo sapiens
catgttgttgtagctgtggtaatgctggctgcatctcagacagggttaacttcagctcctgtggcaaattagcaacaaattctgacatcatatttatggtttctgtatctttgttgatgaaggatggcacaatttttgcttgtgttcataatatactcagattagttcagctccatcagataaactggagacatgcaggacattagggtagtgttgtagctctggtaatga

SEQ ID NO: 466 - DNA, 231 bp, Homo sapiens
caggtacctctttccattggatactgtgctagcaagcatgctctccggggtttttttaatggccttcgaacagaacttgccacatacccaggtataatagtttctaacatttgcccaggacctgtgcaatcaaatattgtggagaattccctagctggagaagtcacaaagactataggcaataatggagaccagtcccacaagatgacaaccagtcgttgtgtgcggctg

SEQ ID NO: 467 - DNA, 311 bp, Homo sapiens
gtacaccctggcacagtccaatctgaactggttcggcactcatctttcatgagatggatgtggtggcttttctcctttttcatcaagactcctcagcagggagcccagaccagcctgcactgtgccttaacagaaggtcttgagattctaagtgggaatcatttcagtgactgtcatgtggcatgggtctctgcccaagctcgtaatgagactatagcaaggcggctgtgggacgtcagttgtgacctgctgggcctcccaatagactaacaggcagtgccagttggacccaagagaagactgcagcagac

SEQ ID NO: 468 - DNA, 3112 bp, Homo sapiens
cattgtgttgggagaaaaacagaggggagatttgtgtggctgcagccgagggagaccaggaagatctgcatggtgggaaggacctgatgatacagagtttgataggagacaattaaaggctggaaggcactggatgcctgatgatgaagtggactttcaaactggggcactactgaaacgatgggatggccagagacacaggagatgagttggagcaagctcaataacaaagtggttcaacgaggacttggaattgcatggagctggagctgaagtttagcccaattgtttactagttgagtgaatgtggatgattggatgatcatttctcatctctgagcctcaggttccccatccataaaatgggatacacagtatgatctataaagtgggatatagtatgatctacttcactgggttatttgaaggatgaattgagataatttatttcaggtgcctagaacaatgcccagattagtacatttggtggaactgagaaatggcataacaccaaatttaatatatgtcagatgttactatgattatcattcaatctcatagttttgtcatggcccaatttatcctcacttgtgcctcaacaaattgaactgttaacaaaggaatctctggtcctgggtaatggctgagcaccactgagcatttccattccagttggcttcttgggtttgctagctgcatcactagtcatcttaaataaatgaagttttaacatttctccagtgatttttttatctcacctttgaagatactatgttatgtgattaaataaagaacttgagaagaacaggtttcattaaacataaaatcaatgtagacgcaaattttctggatgggcaatacttatgttcacaggaaatgctttaaaatatgcagaagataattaaatggcaatggacaaagtgaaaaacttagactttttttttttttttggaagtatctggatgttccttagtcacttaaaggagaactgaaaaatagcagtgagttccacataatccaacctgtgagattaaggctctttgtggggaaggacaaagatctgtaaatttacagtttccttccaaagccaacgtcgaattttgaaacatatcaaagctcttcttcaagacaaataatctatagtacatctttcttatgggatgcacttatgaaaaatggtggctgtcaacatctagtcactttagctctcaaaatggttcattttaagagaaagttttagaatctcatatttattcctgtggaaggacagcattgtggcttggactttataaggtctttattcaactaaataggtgagaaataagaaaggctgctgactttaccatctgaggccacacatctgctgaaatggagataattaacatcactagaaacagcaagatgacaatataatgtctaagtagtgacatgtttttgcacatttccagcccctttaaatatccacacacacaggaagcacaaaaggaagcacagagatccctgggagaaatgcccggccgccatcttgggtcatcgatgagcctcgccctgtgcctggtcccgcttgtgagggaaggacattagaaaatgaattgatgtgttccttaaaggatgggcaggaaaacagatcctgttgtggatatttatttgaacgggattacagatttgaaatgaagtcacaaagtgagcattaccaatgagaggaaaacagacgagaaaatcttgatggcttcacaagacatgcaacaaacaaaatggaatactgtgatgacatgaggcagccaagctggggaggagataaccacggggcagagggtcaggattctggccctgctgcctaaactgtgcgttcataaccaaatcatttcatatttctaaccctcaaaacaaagctgttgtaatatctgatctctacggttccttctgggcccaacattctccatatatccagccacactcatttttaatatttagttcccagatctgtactgtgacctttctacactgtagaataacattactcattttgttcaaagacccttcgtgttgctgcctaatatgtagctgactgtttttcctaaggagtgttctggcccaggggatctgtgaacaggctgggaagcatctcaagatctttccagggttatacttactagcacacagcatgatcattacggagtgaattatctaatcaacatcatcctcagtgtctttgcccatactgaaattcatttcccacttttgtgcccattctcaagacctcaaaatgtcattccattaatatcacaggattaacttttttttttaacctggaagaattcaatgttacatgcagctatgggaatttaattacatattttgttttccagtgcaaagatgactaagtcctttatccctcccctttgtttgattttttttccagtataaagttaaaatgcttagccttgtactgaggctgtatacagccacagcctctccccatccctccagccttatctgtcatcaccatcaacccctcccatgcacctaaacaaaatctaacttgtaattccttgaacatgtcaggcatacattattccttctgcctgagaagctcttccttgtctcttaaatctagaatgatgtaaagttttgaataagttgactatcttacttcatgcaaagaagggacacatatgagattcatcatcacatgagacagcaaatactaaaagtgtaatttgattataagagtttagataaatatatgaaatgcaagagccacagagggaatgtttatggggcacgtttgtaagcctgggatgtgaagcaaaggcagggaacctcatagtatcttatataatatacttcatttctctatctctatcacaatatccaacaagcttttcacagaattcatgcagtgcaaatccccaaaggtaacctttatccatttcatggtgagtgcgctttagaattttggcaaatcatactggtcacttatctcaactttgagatgtgtttgtccttgtagttaattgaaagaaatagggcactcttgtgagccactttagggttcactcctggcaataaagaatttacaaagagcaaaaaaaaaaaaaaaaaaaaaaaa

SEQ ID NO: 469 - DNA, 2229 bp, Homo sapiens
agctctttgtaaattctttattgccaggagtgaaccctaaagtggctcacaagagtgccctatttctttcaattaactacaaggacaaacacatctcaaagttgagataagtgaccagtatgatttgccaaaattctaaagcgcactcaccatgaaatggataaaggttacctttggggatttgcactgcatgaattctgtgaaaagcttgttggatattgtgatagagatagagaaatgaagtatattatataagatactatgaggttccctgcctttgcttcacatcccaggcttacaaacgtgccccataaacattccctctgtggctcttgcatttcatatatttatctaaactcttataatcaaatacacttttagtatttgctgtctcatgtgatgatgaatctcatatgtgtcccttctttgcatgaagtaagatagtcaacttattcaaaactttacatcattctagatttaagagacaaggaagagcttctcaggcagaaggaataatgtatgcctgacatgttcaaggaattacaagttagattttgtttaggtgcatgggaggggttgatggtgatgacagataaggctggagggatggggagaggctgtggctgtatacagcctcagtacaaggctaagcattttaactttatactggaaaaaaaatcaaacaaaggggagggataaaggacttagtcatctttgcactggaaaacaaaatatgtaattaaattcccatagctgcatgtaacattgaattcttccaggttaaaaaaaaagttaatcctgtgatattaatggaatgacattttgaggtcttgagaatgggcacaaaagtgggaaatgaatttcagtatgggcaaagacactgaggatgatgttgattagataattcactccgtaatgatcatgctgtgtgctagtaagtataaccctggaaagatcttgagatgcttcccagcctgttcacagatcccctgggccagaacactccttaggaaaaacagtcagctacatattaggcagcaacacgaagggtctttgaacaaaatgagtaatgttattctacagtgtagaaaggtcacagtacagatctgggaactaaatattaaaaatgagtgtggctggatatatggagaatgttgggcccagaaggaaccgtagagatcagatattacaacagctttgttttgagggttagaaatatgaaatgatttggttatgaacgcacagtttaggcagcagggccagaatcctgaccctctgccccgtggttatctcctccccagcttggctgcctcatgtcatcacagtattccattttgtttgttgcatgtcttgtgaagccatcaagattttctcgtctgttttcctctcattggtaatgctcactttgtgacttcatttcaaatctgtaatcccgttcaaataaatatccacaacaggatctgttttcctgcccatcctttaaggaacacatcaattcattttctaatgtccttccctcacaagcgggaccaggcacagggcgaggctcatcgatgacccaagatggcggccgggcatttctcccagggatctctgtgcttccttttgtgcttcctgtgtgtgtggatatttaaaggggctggaaatgtgcaaaaacatgtcactacttagacattatattgtcatcttgctgtttctagtgatgttaattatctccatttcagcagatgtgtggcctcagatggtaaagtcagcagcctttcttatttctcacctggaaatacatacgaccatttgaggagacaaatggcaaggtgtcagcataccctgaacttgagttgagagctacacacaatattattggtttccgagcatcacaaacaccctctctgtttcttcactgggcacagaattttaatacttatttcagtgggctgttggcaggaacaaatgaagcaatctacataaagtcactagtgcagtgcctgacacacaccattctcttgaggtcccctctagagatcccacaggtcatatgacttcttggggagcagtggctcacacctgtaatcccagcactttgggaggctgaggcaggtgggtcacctgaggtcaggagttcaagaccagcctggccaatatggtgaaaccccatctctactaaaaatacaaaaattagctgggcgtgctggtgcatgcctgtaatcccagccccaacacaatggaatt

SEQ ID NO: 470 - DNA, 2426 bp, Homo sapiens
gtaaattctttattgccaggagtgaaccctaaagtggctcacaagagtgccctatttctttcaattaactacaaggacaaacacatctcaaagttgagataagtgaccagtatgatttgccaaaattctaaagcgcactcaccatgaaatggataaaggttacctttggggatttgcactgcatgaattctgtgaaaagcttgttggatattgtgatagagatagagaaatgaagtatattatataagatactatgaggttccctgcctttgcttcacatcccaggcttacaaacgtgccccataaacattccctctgtggctcttgcatttcatatatttatctaaactcttataatcaaattacacttttagtatttgctgtctcatgtgatgatgaatctcatatgtgtcccttctttgcatgaagtaagatagtcaacttattcaaaactttacatcattctagatttaagagacaaggaagagcttctcaggcagaaggaataatgtatgcctgacatgttcaaggaattacaagttagattttgtttaggtgcatgggaggggttgatggtgatgacagataaggctggagggatggggagaggctgtggctgtatacagcctcagtacaaggctaagcattttaactttatactggaaaaaaaatcaaacaaaggggagggataaaggacttagtcatctttgcactggaaaacaaaatatgtaattaaattcccatagctgcatgtaacattgaattcttccaggttaaaaaaaaaagttaatcctgtgatattaatggaatgacattttgaggtcttgagaatgggcacaaaagtgggaaatgaatttcagtatgggcaaagacactgaggatgatgttgattagataattcactccgtaatgatcatgctgtgtgctagtaagtataaccctggaaagatcttgagatgcttcccagcctgttcacagatcccctgggccagaacactccttaggaaaaacagtcagctacatattaggcagcaacacgaagggtctttgaacaaaatgagtaatgttattctacagtgtagaaaggtcacagtacagatctgggaactaaatattaaaaatgagtgtggctggatatatggagaatgttgggcccagaaggaaccgtagagatcagatattacaacagctttgttttgagggttagaaatatgaaatgatttggttatgaacgcacagtttaggcagcagggccagaatcctgaccctctgccccgtggttatctcctccccagcttggctgcctcatgtcatcacagtattccattttgtttgttgcatgtcttgtgaagccatcaagattttctcgtctgttttcctctcattggtaatgctcactttgtgacttcatttcaaatctgtaatcccgttcaaataaatatccacaacaggatctgttttcctgcccatcctttaaggaacacatcaattcattttctaatgtccttccctcacaagcgggaccaggcacagggcgaggctcatcgatgacccaagatggcggccgggcatttctcccagggatctctgtgcttccttttgtgcttcctgtgtgtgtggatatttaaaggggctggaaatgtgcaaaaacatgtcactacttagacattatattgtcatcttgctgtttctagtgatgttaattatctccatttcagcagatgtgtggcctcagatggtaaagtcagcagcctttcttatttctcacctggaaatacatacgaccatttgaggagacaaatggcaaggtgtcagcataccctgaacttgagttgagagctacacacaatattattggtttccgagcatcacaaacaccctctctgtttcttcactgggcacagaattttaatacttatttcagtgggctgttggcaggaacaaatgaagcaatctacataaagtcactagtgcagtgcctgacacacaccattctcttgaggtcccctctagagatcccacaggtcatatgacttcttggggagcagtggctcacacctgtaatcccagcactttgggaggctgaggcaggtgggtcacctgaggtcaggagttcaagaccagcctggccaatatggtgaaaccccatctctactaaaaatacaaaaattagctgggcgtgctggtgcatgcctgtaatcccagctacttgggaggctgaggcaggagaattgctggaacatgggaggcggaggttgcagtgagctgtaattgtgccattgcactcgaacctgggcgacagagtggaactctgtttccaaaaaacaaacaaacaaaaaaggcatagtcagatacaacgtgggtgggatgtgtaaatagaagcaggatataaagggcatggggtgacggttttgcccaacacaatg

SEQ ID NO: 471 - DNA, 812 bp, Homo sapiens
gaacaaaatgagtaatgttattctacagtgtagaaaggtcacagtacagatctgggaactaaatattaaaaatgagtgtggctggatatatggagaatgttgggcccagaaggaaccgtagagatcagatattacaacagctttgttttgagggttagaaatatgaaatgatttggttatgaacgcacagtttaggcagcagggccagaatcctgaccctctgccccgtggttatctcctccccagcttggctgcctcatgtcatcacagtattccattttgtttgttgcatgtcttgtgaagccatcaagattttctcgtctgttttcctctcattggtaatgctcactttgtgacttcatttcaaatctgtaatcccgttcaaataaatatccacaacaggatctgttttcctgcccatcctttaaggaacacatcaattcattttctaatgtccttccctcacaagcgggaccaggcacagggcgaggctcatcgatgacccaagatggcggccgggcatttctcccagggatctctgtgcttccttttgtgcttcctgtgtgtgtggatatttaaaggggctggaaatgtgcaaaaacatgtcactacttagacattatattgtcatcttgctgtttctagtgatgttaattatctccatttcagcagatgtgtggcctcagatggtaaagtcagcagcctttcttatttctcacctctgtatcatcaggtccttcccaccatgcagatcttcctggtctccctcggctgcagccacacaaatctcccctctgtttttctgatgccag

SEQ ID NO: 472 - DNA, 515 bp, Homo sapiens
  misc_feature (1)...(515): n = A,T,C or G
acggagacttattttctgatattgtctgcatatgtatgtttttaagagtctggaaatagtcttatgactttcctatcatgcttattaataaataatacagcccagagaagatgaaaatgggttccagaattattggtccttgcagcccggtgaatctcagcaagaggaaccaccaactgacaatcaggatattgaacctggacaagagagagaaggaacacctccgatcgaagaacgtaaagtagaaggtgattgccaggaaatggatctggaaaagactcggagtgagcgtggagatggctctgatgtaaaagagaagactccacctaatcctaagcatgctaagactaaagaagcaggagatgggcagccataagttaaaaagaagacaagctgaagctacacacatggctgatgtcacattgaaaatgtgactgaaaatttgaaaattctctcaataaagtttgagttttctctgaagaaaaaaaaanaaaaaaaaaaaanaaaaanaaaaa

SEQ ID NO: 473 - DNA, 5829 bp, Homo sapiens
cgcatgccggggaagcccaagctggctcgaagagccaccagccacctgtgcaagggtgggcctggaccagttggaccagccaccaagctcacctactcaaggaagcagggatggccaggttgcaacagcctgagtggctgccacctgatagctgatggagcagaggcctgaggaaaatcagatggcacatttagctctttaatggatcttaagttaatttttctataaagcacatggcaccagtccatgcctcagagctcgtatggcactgcggaccacagcaggccgagttcccaggattgccatccaggggggccttctgtagccctggccagaccttgcagaggtggctgggtgctctttgagcgagctcggcctccctggcatgcacaggccccaggtactgacacgctgctctgagtgagcttgtcctgccttggctgccacctaactgctgatggagcagcggccttaggaaaagcaaatggcgctgtagcccaactttagggtagaagaagatgtaccatgtccggccgctagttggtgactggtgcacctgctcctggcgtacccttgcagaggtgggtggttgctctttggccagcttggccttgcctggcatgcacaagcctcagtgcaacaactgtcctacaaatggagacacagagaggaaacaagcagcgggctcaggagcagggtgtgtgctgcctttggggctccagtccatgcctcgggtcgtatggtactgcaggcttcttggttgccaagaggcggaccacaggccttcttgaggaggactttacgttcaagtgcagaaagcagccaaaattaccatccatgagactaagccttctgtggccctggcgagacttaaaatttgtgccaaggcaggacaagctcactcggagcagcgtgtcagtagctggggcctatgcatgccgggcagggccgggctggctgaaggagcaaccagccacctctgcaagggtgcgcctagtgcaggcggagcatccaccacctcacccgctcgaggaagtggggatggccaggttcccacagcctgagtgtctgccaccttattgctgatggagcagaggccttaagaaaagcagatggcactgtggccctacctttagggtggaagaagtgatgtacatgtccggacgctaattggtgactggtacaccggctcctgctacacctttgcagaggtggctggttgctctttgagccagcttgtccttgcccggcatgcacaagtttcagtgcaacaactttgccacaaatggagccatatagaggaaacaagaagcaggttcaggagaagggtgtaccctgcctttggggctccagtccatgcctcaggtgtcacatggcactgcgggcttcttggttgccaggaggcggaccacaggccatcttggggaggactttgtgttcaagtgcagaaagcagccaggattgccatccagggggaccttctatagccctggccaaaccttgcaggggtgtctggttgctctttgagccggcttggcctccctggcatgcacgggccccaggtgctggcacgctgctccgagtgtgcttgtcctgccttggctgccacctctgcgggggtgcgtctggagggggtggaccggccaccaaccttacccagtcaaggaagtggatggccatgttcccacagcctgagtggctgccacctgatggctgatggagcaaaggccttaggaaaagcagatggcccttggccctacctttttgttagaagaactgatgttccatgtcctgcagcgagtgaggttggtggctgtgcccccagctcctggcgcgccctcgcagaggtgactggttgctctttgggccctcttggccttgcccagcatgcacaagcctcagtgctactactgtgctacaaatggagccatataggggaaacgagcagccatctcaggagcaaggtgtatgctgcctttgggggctccagtccttgcctcaagggtcttatgtcactgtgggcttcttggttgtcaagaggcagaccataggccgtcttgagagggactttatgttcaagtgcagaaagcagccaggattgccaccctcgggactctgccttctgtggccctggccaaacttagaatttggccgtagacaggacaggctcacttggagtagcgtgtccgtagctggggtctgtgcatgccgggcaaggccgggctggctcggggagcaaccagccacctctgcgggggtgcgcctggagcaggtggagcagccaccagctcacccactccaggaagccggggtagccaggttcccaaggcctgagtgggtgccacctaatggctgaagaaacagaggccttgggaaaaccagatggcactgtggccctacctttatggtagaagagctgatttagcctgactggcagcgtgtggggttggtggctggtctgcctgctgctggcgcatccgtgcaaggatggctggttgccctttgagccagcttgcccttgcccggcatgcgcaagcctcagtgcaacaactgtgctgcaaatggggccatatagaggaaaggagcagctggctctggagcatggtgtgcactccctttgggccttcagtccatgtctcatgggtcgtatgacactgcgggcttgttggttgccaagaggcagaccacaggtcatcttgaggaggactttatgttccagtccagaaagcagccagtggtaccacccaggggacttgtgcttctgtgcccaggccagacgtagaatttgacaaagtcaggacggtctcagtcagagcggcgtgtcggtccccggggcctgtgcatgccgggcagggccgggctggcttggggagcaagcagccacctctgttaagggtgtgcctggagcaggtggagcagccaccaacctcacgcactgaaagaagcagggatggccaggttccaacatcctgagtggctgccacctgatggctgatggagcagaggcctgaggaaaagcagatggcactgctttgtagtgctgttctttgtctctcttgatctttttcagttaatgtctgttttatcagagactaggattgcaaaccctgctcttttttgctttccatttgcttggtaaatattcctccatccctttattttaagcctatgtgtgtctttgcacatgagatgggtctcctgaatacaggacaacaatgggtctttactctttatccaacttgccagtctgtgtcttttaactggggcatttagcccatttacatttaagtttagtattgttacatgtgaaatttatcctgtcatgatgttgctagctttttatttttcccattagtttgcagtttctttatagtgtcaatggtctttacaattcgatatgtttttgtagtggctggtactggtttttcctttctacgtttagtgtctccttcaggagctcttgtaacacaagaatgtggatttatttcttgtaaggtaaatatgtggatttatttcttgggactgtattctatggcctttaccccaagaatcattactttttaaaatgcaattcaaattagcataaaacatttacagcctatggaaaggcttgtggcattagaatccttatttataggattattttgtgtttttttgagatatggtctttgtcatcgaggcagaagtgccgtggtttgatcataattcaccacagccctgaactcttgagtccaagccatccttttgccttaatctcccaaccagttggatctgcaggcataaggcatcatgcgtggctaattttttcacgttttttttttttttttgtcgagattatggtgtcactgtgttgctctggctgatctcaaatgtttgacctcaagggatctttctgccacggcctcctaaagtgctaggattatatgcatgatacaccatgcctattgtagagtattacattattttcaaagtcttattgtaagagccatttattgcctttggcctaaataactcaatataatatctctgaaacttttttttgacaaattttggggcgtgatgatgagagaagggggtttgaaactttctaataagagttaacttagagccatttaagaaaggaaaaaacacaaattatcagaaaaacaacagtaagatcaagtgcaaaagttctgtggcaaagatgatgagagtaaagaatatatgtttgtgactcatggtggcttttactttgttcttgaatttctgagtacgggttaacatttaaagaatctacattatagataacattttattgcaagtaaatgtatttcaaaatttgttattggttttgtatgagattattctcagcctacttcattatcaagctatattattttattaatgtagttcgatgatcttacagcaaagctgaaagctgtatcttcaaaatatgtctatttgactaaaaagttattcaacaggagttattatctataaaaaaaatacaacaggaatataaaaaacttgaggataaaaagatgttggaaaaagtaatattaaatcttaaaaaacatatggaaactacacaatggtgaagacacattggtgaagtacaaaaatataaattggatctagaagaaagggcaatgcaggcaatagaaaaattagtagaaatccctttaaaggttagtttgtaaaatcaggtaagtttatttataatttgctttcatttatttcactgcaaattatattttggatatgtatatatattgtgcttcctctgcctgtcttacagcaatttgccttgcagagttctaggaaaaaggtggcatgtgtttttactttcaaaatatttaaatttccatcattataacaaaatcaatttttcagagtaatgattctcactgtggagtcatttgattattaagacccgttggcataagattacatcctctgactataaaaatcctggaagaaaacctaggaaatattcgtctggacattgcacttggcaatgaatttatgggtaaccactgatccacttccagtcactatccatgagtttttatttccagatacatgaaatcatatgagttgaaactttcttttgattgagcagtttggaaaccgtctttttgtagaatctgcaagtggatatttggaaccctttgaggcctatgctgaaaaaagaaatatcttcactacatgatgaccaccagcagcagctggggaaaccagcaccctgtggaattccatacggtgcatagaatacatcctcccttcagtcggcttgggtcaacttaggtcatgggccacctggctgatagcagtttccacagaaatgcttcaagatgaaagtggatgaccgggccaccctccaccactgccctgtaagaccatgggacacacaggccaccagttcttttcatgtggtcatcccctgttagatgggagaaaatacacctgcctcatttttgtaccttctgtgtgaacattccacggcagactgtcgctaaatgtggatgaagaattgaatgaatgaatgaatatgagagaaaatgaataaatggttcagatcctgggctggaaggctgtgtatgaggatggtgggtagaggagggtctgtttttcttgcctttaagtcactaattgtcactttggggcaggagcacaggctttgaatgcagaccgactggactttaattctggctttactagttgtgattgtgtgaccttgtgaaagttacttaaaccctctgtgcctgtttctttatctgtaaaatggagataataagatgtcaaaggactgtggtaagaattaaatgctttaaaaaaaaaaaaaaaaaa

SEQ ID NO: 474 - DNA, 1594 bp, Homo sapiens
atttatggatcattaatgcctctttagtagtttagagaaaacgtcaaaagaaatggccccagaataagcttcttgatttgtaaaattctatgtcattggctcaaatttgtatagtatctcaaaatataaatatatagacatctcagataatatatttgaaatagcaaattcctgttagaaaataatagtacttaactagatgagaataacaggtcgccattatttgaattgtctcctattcgtttttcatttgttgtgttactcatgttttacttatgagggatatatataacttccactgttttcagaattattgtatgcagtcagtatgagaatgcaatttaagtttccttgatgctttttcacacttctattactagaaataagaatacagtaatattggcaaagaaaattgaccagttcaataaaattttttagtaaatctgattgaaaataaacattgcttatggctttcttacatcaatattgttatgtcctagacaccttatctgaaattacggcttcaaaattctaattatgtgcaaatgtgtaaaatatcaatactttatgttcaagctggggcctcttcaggcgtcctgggctgagagagaaagatgctagctccgcaagccggagagggaacaccgccacattgttacacggacacaccgccacgtggacacatgaccagactcacatgtacagacacacggagacattaccacatggagacaccgtcacacagtcacacggacacactggcatagtcacatggacggacacacagacatatggagaaatcacatggacacaccaccacactatcacagggacacagacacacggagacatcaccacatggacacactgtcacactaccacagggacacgagacatcacactgtcacatggacacaccatcacacacatgaacacaccgacacactgccatatggacactggcacacacactgccacactgtcacatggacacacctccacaccatcacaccaccacacacactgcctgtggacacaaggacacacagacactgtcacacagatacacaaaacactgtcacacggagacatcaccatgcagatacaccaccactctggtgccgtctgaattaccctgctggggggacagcagtggcatactcatgcctaagtgactggctttcaccccagtagtgattgccctccatcaacactgcccaccccaggttggggctaccccagcccatctttacaaaacagggcaaggtgaactaatggagtgggtggaggagttggaagaaatcccagcgtcagtcaccgggatagaattcccaaggaaccctctttttggaggatggtttccatttctggaggcgatctgccgacagggtgaatgccttcttgcttgtcttctggggaatcagagagagtccgttttgtggtgggaagagtgtggctgtgtactttgaactcctgtaaattctctgactcatgtccacaaaaccaacagttttgtgaatgtgtctggaggcaagggaagggccactcaggatctatgttgaagggaagaggcctggggctggagtattcgctt

SEQ ID NO: 475 - DNA, 2414 bp, Homo sapiens
  unsure (33): n=A,T,C or G
cccaacacaatggctttataagaatgcttcacntgtgaaaaacaaatatcaaagtcttcttgtagattatttttaaggacaaatctttattccatgtttaatttatttagctttccctgtagctaatatttcatgctgaacacattttaaatgctgtaaatgtagataatgtaatttatgtatcattaatgcctctttagtagtttagagaaaacgtcaaaagaaatggccccagaataagcttcttgatttgtaaaattctatgtcattggctcaaatttgtatagtatctcaaaatataaatatatagacatctcagataatatatttgaaatagcaaattcctgttagaaaataatagtacttaactagatgagaataacaggtcgccattatttgaattgtctcctattcgtttttcatttgttgtgttactcatgttttacttatggggggatatatataacttccgctgttttcagaagtattgtatgcagtcagtatgagaatgcaatttaagtttccttgatgctttttcacacttctattactagaaataagaatacagtaatattggcaaagaaaattgaccagttcaataaaattttttagtaaatctgattgaaaataaacattgcttatggctttcttacatcaatattgttatgtcctagacaccttatctgaaattacggcttcaaaattctaattatgtgcaaatgtgtaaaatatcaatactttatgttcaagctggggcctcttcaggcgtcctgggctgagagagaaagatgctagctccgcaagccggggagggaacaccgccacattgttacatggacacaccgccacgtggacacatgaccagactcacatgtacagacacacggagacattaccacatggagacaccgtcacacagtcacacgagcacactggcatagtcacatggacggacacacagacatatggagaaatcacactgacacaccaccacactatcacagggacacagacacacggagacatcaccacatggacacactgtcacactaccacagggacacgagacatcacactgtcacatggacacaccatcacacacatgaacacaccgacacactgccatatggacactgccacacacactgccacactgtcacatggacacacctccataccatcacaccaccacacacactgccatgtggacacaaggacacacagacactgtcacacagatacacaaaacactgtcacacggagacatcaccatgcagatacaccaccacatggacatagcaccagacactctgccacacagatacaccaccacacagaaatgcggacacactgccacacagacaccaccacatcgttgccacactttcatgtgtcagctggcggtgtgggccccacgactctgggctctaatcgagaaattacttggacatatagtgaaggcaaaatttttttttattttctgggtaaccaagcgcgactctgtctcaaaaaaagaaaaaaaaagcaatatactgtgtaatcgttgacagcataattcactattatgtagatcggagagcagaggattctgaatgcatgaacatatcattaacatttcaatacattactcataattactgatgaactaaagagaaaccaagaaattatggtgatagttatattgacctggagaaatgtagacacaaaagaaccgtaagatgagaaatgtgttaacacagtctataagggcatgcaagaataaaaataggggagaaaacaggagagtttttcaagagctttctggtcatgtaagtcaacttgtatcggttaatttttaaaaggtttatttacatgcaataaactgcacatacttcaattgtacattttggtaattcttggcatttgtagctctataaaaccagcaacatattaaaatagcaaacatatccattacctttaccaccaaagttttcttgtgttttttctactcactttttcctgcctatccccccatctcttccacaggtaaccactgatccacttccagtcactatccatgagtttttatttccaaatacatgaaatcatatgaatttctggtttttcctgttggagcccaaggagcaagggcagaatgaggaacatgatgtttcttwccgacagttactcatgacgtctccatccaggactgaggggggcatccttctccatctaggactgggggcatccttctccatccagtattgggggtcatccttctccatccagtattgggggtcatcctcctccatccaggacctgaggggtgtccttttctgcgcttccttggatggcagtctttcccttcatgtttatagtracttaccattaaatcactgtgccgttttttcctaaaataaaaaaaaaaaaaaaaa

SEQ ID NO: 476 - DNA, 3434 bp, Homo sapiens
ctgtgctgcaaatggggccatatagaggaaaggagcagctggctctggagcatggtgtgcactccctttgggccttcagtccatgtctcatgggtcgtatgacactgcgggcttgttggttgccaagaggcagaccacaggtcatcttgaggaggactttatgttccagtccagaaagcagccagtggtaccacccaggggacttgtgcttctgtggcccaggccagacgtagaatttgacaaagtcaggacggtctcagtcagagcagcatgtcggtccccggggcctgtgcatgccgggcagggccaggctggcttaaggagcaagcagccacctctgttaggggtgtgcctggagcaggtggagcagccaccaacctcacgcactgaaagaagcagggatggccaggttccaacatcctgagtggctgccacctgatggctgatggagcagaggcctgaggaaaagcagatggcactgctttgtagtgctgttctttgtctctcttgatctttttcagttaatgtctgttttatcagagactaggattgcaaaccctgctcttttttgctttccatttgcttggtaaatattcctccatccctttattttaagcctatgtgtgtctttgcacatgagatgggtctcctgaatacaggacaacaatgggtctttactctttatccaacttgccagtctgtgtcttttaactggggcatttagcccatttacatttaagtttagtatttgttacatgtgaaatttatcctgtcatgatgttgctagctttttatttttcccattagtttgcagtttctttatagtgtcaatggtctttacaattcgatatgtttttgtagtggctggtactggtttttcctttctacgtttagtgtctccttcaggagctcttgtaacacaagaatgtggatttatttcttgtaaggtaaatatgtggatttattctgggactgtattctatggcctttaccccaagaatcattactttttaaaatgcaattcaaattagcataaaacatttacagcctatggaaaggcttgtggcattagaatccttatttataggattattttgtgtttttttgagatatggtctttgtcatcgaggcagaagtgccgtggtttgatcataattcaccacagccctgaactcttgagtccaagccatccttttgccttaatctcccaaccagttggatctacaagcataaggcatcatgcgtggctaattttttcacgttttttttttttttgtcgagattatggtatcactgtgttgctctggctgatctcaaatgtttgacctcaagggatctttctgccacagcctcctaaagtgctaggattatatgcatgatacaccatgcctattgtagagtattacattattttcaaagtcttattgtaagagccatttattgcctttggcctaaataactcaatataatatctctgaaacttttttttgacaaattttggggcgtgatgatgagagaagggggtttgaaactttctaataagagttaacttagagccatttaagaaaggaaaaaacacaaattatcagaaaaacaacagtaagatcaagtgcaaaagttctgtggcaaagatgatgagagtaaagaatatatgtttgtgactcatggtggcttttactttgttcttgaatttctgagtacgggttaacatttaaagaatctacattatagataacattttattgcaagtaaatgtatttcaaaatttgttattggttttgtatgagattattctcagcctacttcattatcaagctatattattttattaatgtagttcgatgatcttacagcaaagctgaaagctgtatcttcaaaatatgtctatttgactaaaaagttattcaacaggagttattatctataaaaaaatacaacaggaatataaaaaacttgaggataaaaagatgttggaaaaagtaatattaaatcttaaaaaacatatggaaactacacaatggtgaagacacattggtgaagtacaaaaatataaattggatctagaagaaagggcaatgcaggcaatagaaaaattagtagaaatccctttaaaggttagtttgtaaaatcaggtaagtttatttataatttgctttcatttatttcactgcaaattatattttggatatgtatatatattgtgcttcctctgcctgtcttacagcaatttgccttgcagagttctaggaaaaaggtggcatgtgtttttactttcaaaatatttaaatttccatcattataacaaaatcaatttttcagagtaatgattctcactgtggagtcatttgattattaagacccgttggcataagattacatcctctgactataaaaatcctggaagaaaacctaggaaatattcgtctggacattgcacttggcaatgaatttatgggcgctttggaatcctgcagatataataatgataattaaacaaaacactcagagaaactgccaaccctaggatgaagtatattgttactgtgctttgggattaaaataagtaactacagtttatagaacttttatactgatacacagacactaaaaagggaaagggtttagatgagaagctctgctatgcaatcaagaatctcagccactcatttctgtaggggctgcaggagctccctgtaaagagaggttatggagtctgtagcttcaggtaagatacttaaaacccttcagagtttctccattttttcccatagtttccccaaaaaggttatgacactttataagaatgcttcacttgtgaaaaacaaatatcaaagtcttcttgtagattatttttaaggacaaatctttattccatgtttaatttatttagctttccctgtagctaatatttcatgctgaacacattttaaatgctgtaaatgtagataatgtaatttatgtatcattaatgcctctttagtagtttagagaaaacgtcaaaagaaatggccccagaataagcttcttgatttgtaaaattctatgtcattggctcaaatttgtatagtatctcaaaatataaatatatagacatctcagataatatatttgaaatagcaaattcctgttagaaaataatagtacttaactagatgagaataacaggtcgccattatttgaattgtctcctattcgtttttcatttgttgtgttactcatgttttacttatggggggatatatataacttccgctgttttcagaagtattgtatgcagtcagtatgagaatgcaatttaagtttccttgatgctttttcacacttctattactagaaataagaatacagtaatattggcaaagaaaattgaccagttcaataaaattttttagtaaatctgattgaaaataaaaaaaaaaaaaaaaaaaaaaaaa

SEQ ID NO: 477 - protein, 140 aa, Homo sapiens
MDGHTDIWRNHMDTPPHYHRDTDTRRHHHMDTLSHYHRDTRHHTVTWTHHHTHEHTDTLPYGHWHTHCHTVTWTHLHTITPPHTLPVDTRTHRHCHTDTQNTVTRRHHHADTPPLWCRLNYPAGGTAVAYSCLSDWLSPQ

SEQ ID NO: 478 - protein, 143 aa, Homo sapiens
MYRHTETLPHGDTVTQSHGHTGIVTWTDTQTYGEITWTHHHTITGTQTHGDITTWTHCHTTTGTRDITLSHGHTITHMNTPTHCHMDTGTHTATLSHGHTSTPSHHHTHCLWTQGHTDTVTQIHKTLSHGDITMQIHHHSGAV

SEQ ID NO: 479 - protein, 222 aa, Homo sapiens
MYRHTETLPHGDTVTQSHEHTGIVTWTDTQTYGEITLTHHHTITGTQTHGDITTWTHCHTTTGTRDITLSHGHTITHMNTPTHCHMDTATHTATLSHGHTSIPSHHHTHCHVDTRTHRHCHTDTQNTVTRRHHHADTPPHGHSTRHSATQIHHHTEMRTHCHTDTTTSLPHFHVSAGGVGPTTLGSNREITWTYSEGKIFFYFLGNQARLCLKKRKKKQYTV

SEQ ID NO: 480 - protein, 144 aa, Homo sapiens [sequence omitted]

SEQ ID NO: 481 - protein, 167 aa, Homo sapiens
MHGPQVLARCSECACPALAATSAGVRLEGVDRPPTLPSQGSGWPCSHSLSGCHLMADGAKALGKADGPWPYLFVRRTDVPCPAASEVGGCAPSSWRALAEVTGCSLGPLGLAQHAQASVLLLCYKWSHIGETSSHLRSKVYAAFGGSSPCLKGLMSLWASWLSRGRP

SEQ ID NO: 482 - protein, 143 aa, Homo sapiens [sequence omitted]

SEQ ID NO: 483 - protein, 143 aa, Homo sapiens
METQRGNKQRAQEQGVCCLWGSSPCLGSYGTAGFLVAKRRTTGLLEEDFTFKCRKQPKLPSMRLSLLWPWRDLKFVPRQDKLTRSSVSVAGAYACRAGPGWLKEQPATSARVRLVQAEHPPPHPLEEVGMARFPQPECLPPYC

SEQ ID NO: 484 - protein, 30 aa, Homo Sapien
TAASDNFQLSQGGQGFAIPIGQAMAIAGQI

SEQ ID NO: 485 - DNA, 31 bp, Artificial Sequence
  Made in a lab
gggaagcttatcacctatgtgccgcctctgc

SEQ ID NO: 486 - DNA, 27 bp, Artificial Sequence
  Made in a lab
gcgaattctcacgctgagtatttggcc

SEQ ID NO: 487 - DNA, 36 bp, Artificial Sequence
  Made in a lab
cccgaattcttagctgcccatccgaacgccttcatc

SEQ ID NO: 488 - DNA, 33 bp, Artificial Sequence
  Made in a lab
gggaagcttcttccccggctgcaccagctgtgc

SEQ ID NO: 489 - protein, 19 aa, Artificial Sequence
  Made in a lab
MDRLVQRFGTRAVYLASVA

SEQ ID NO: 490 - protein, 20 aa, Artificial Sequence
  Made in a lab
YLASVAAFPVAAGATCLSHS

SEQ ID NO: 491 - protein, 20 aa, Artificial Sequence
  Made in a lab
TCLSHSVAVVTASAALTGFT

SEQ ID NO: 492 - protein, 20 aa, Artificial Sequence
  Made in a lab
ALTGFTFSALQILPYTLASL

SEQ ID NO: 493 - protein, 20 aa, Artificial Sequence
  Made in a lab
YTLASLYHREKQVFLPKYRG

SEQ ID NO: 494 - protein, 20 aa, Artificial Sequence
  Made in a lab
LPKYRGDTGGASSEDSLMIS

SEQ ID NO: 495 - protein, 20 aa, Artificial Sequence
  Made in a lab
DSLMTSFLPGPKPGAPFPNG

SEQ ID NO: 496 - protein, 21 aa, Artificial Sequence
  Made in a lab
APFPNGHVGAGGSGLLPPPPA

SEQ ID NO: 497 - protein, 20 aa, Artificial Sequence
  Made in a lab
LLPPPPALCGASACDVSVRV

SEQ ID NO: 498 - protein, 20 aa, Artificial Sequence
  Made in a lab
DVSVRVVVGEPTEARVVPGR

SEQ ID NO: 499 - protein, 20 aa, Artificial Sequence
  Made in a lab
RVVPGRGICLDLAILDSAFL

SEQ ID NO: 500 - protein, 20 aa, Artificial Sequence
  Made in a lab
LDSAFLLSQVAPSLFMGSIV

SEQ ID NO: 501 - protein, 20 aa, Artificial Sequence
  Made in a lab
FMGSIVQLSQSVTAYMVSAA

SEQ ID NO: 502 - DNA, 414 bp, Homo Sapien
  misc_feature (1)...(414): n=A,T,C or G
caccatggagacaggcctgcgctggcttttcctggtcgctgtgctcaaaggtgtccaatgtcagtcggtggaggagtccgggggtcgcctggtcacgcctgggacacctttgacantcacctgtagagtttttggaatngacctcagtagcaatgcaatgagctgggtccgccaggctccagggaaggggctggaatggatcggagccattgataattgtccacantacgcgacctgggcgaaaggccgattnatnatttccaaaacctngaccacggtggatttgaaaatgaccagtccgacaaccgaggacacggccacctatttttgtggcagaatgaatactggtaatagtggttggaagaatatttggggcccaggcaccctggtcaccgtntcctcagggcaacctaa

SEQ ID NO: 503 - DNA, 379 bp, Homo Sapien
  misc_feature (1)...(379): n=A,T,C or G
atncgatggtgcttggtcaaaggtgtccagtgtcagtcggtggaggagtccgggggtcgcctggtcacgcctgggacacccctgacactcacctgcaccgtntctggattngacatcagtagctatggagtgagctgggtccgccaggctccagggaaggggctggnatacatcggatcattagtagtagtggtacattttacgcgagctgggcgaaaggccgattcaccatttccaaaacctngaccacggtggatttgaaaatcaccagtttgacaaccgaggacacggccacctatttntgtgccagaggggggtttaattataaagacatttggggcccaggcaccctggtcaccgtntccttagggcaacctaa

SEQ ID NO: 504 - protein, 19 aa, Artificial Sequence
  Made in a lab
GFTNYTDFEDSPYFKENSA

SEQ ID NO: 505 - protein, 20 aa, Artificial Sequence
  Made in a lab
KENSAFPPFCCNDNVTNTAN

SEQ ID NO: 506 - DNA, 407 bp, Homo Sapien
atggagacaggcctgcgctggcttctcctggtcgctgcgctcaaaggtgtccagtgtcagtcgctggaggagtccgggggtcgcctggtcacgcctgggacacccctgacactcacctgcaccgtctctggattctccctcagtagcaatgcaatgatctgggtccgccaggctccagggaaggggctggaatacatcggatacattagttatggtggtagcgcatactacgcgagctgggtgaaaggccgattcaccatctccaaaacctcgaccacggtggatctgagaatgaccagtctgacaaccgaggacacggccacctatttctgtgccagaaatagtgattttagtggtatgttgtggggcccaggcaccctggtcaccgtctcctcagggcaacctaa

SEQ ID NO: 507 - DNA, 422 bp, Homo Sapien
atggagacaggcctgcgctggcttctcctggtcgctgtgctcaaaggtgtccagtgtcagtcggtggaggagtccgggggtcgcctggtcacgcctgggacacccctgacactcacctgtacagtctctggattctccctcagcaactacgacctgaactgggtccgccaggctccagggaaggggctggaatggatcgggatcattaattatgttggtaggacggactacgcgaactgggcaaaaggccggttcaccatctccaaaacctcgaccaccgtggatctcaagatcgccagtccgacaaccgaggacacggccacctatttctgtgccagagggtggaagtgcgatgagtctggtccgtgcttgcgcatctggggcccaggcaccctggtcaccgtctccttagggcaacctaa

SEQ ID NO: 508 - DNA, 411 bp, Homo Sapien
  misc_feature (1)...(411): n=A,T,C or G
atggagacaggcctcgctggcttctcctggtcgctgtgctcaaaggtgtccagtgtcagtcggtggaggagtccgggggtcgcctggtcacgcctgggacacccctgacactcacctgcacagtctctggaatcgacctcagtagctactgcatgagctgggtccgccaggctccagggaaggggctggaatggatcggaatcattggtactcctggtgacacatactacgcgaggtgggcgaaaggccgattcaccatctccaaaacctcgaccacggtgcatntgaaaatcnccagtccgacaaccgaggacacggccacctatttctgtgccagagatcttcgggatggtagtagtactggttattataaaatctggggcccaggcaccctggtcaccgtctccttgg

SEQ ID NO: 509 - protein, 15 aa, Artificial Sequence
  Made in a lab
LCKFTEWIEKTVQAS

SEQ ID NO: 510 - protein, 15 aa, Artificial Sequence
  Made in a lab
PEYNRPLLANDLMLI

SEQ ID NO: 511 - protein, 15 aa, Artificial Sequence
  Made in a lab
YHPSMFCAGGGQDQK

SEQ ID NO: 512 - protein, 15 aa, Artificial Sequence
  Made in a lab
DSGGPLICNGYLQGL

SEQ ID NO: 513 - protein, 15 aa, Artificial Sequence
  Made in a lab
APCGQVGVPBVYTNL

SEQ ID NO: 514 - protein, 15 aa, Artificial Sequence
  Made in a lab
LCKFTEWIEKTVQAS

SEQ ID NO: 515 - protein, 15 aa, Artificial Sequence
  Made in a lab
MVEASLSVRHPEYNR

SEQ ID NO: 516 - protein, 15 aa, Artificial Sequence
  Made in a lab
VSESDTIRSISIASQ

SEQ ID NO: 517 - protein, 15 aa, Artificial Sequence
  Made in a lab
EVCSKLYDPLYHPSM

SEQ ID NO: 518 - protein, 15 aa, Artificial Sequence
  Made in a lab
RAEPGTEARRHYDEG

SEQ ID NO: 519 - protein, 17 aa, Artificial Sequence
  Made in a lab
RAEPGTEARRNYDEGCG

SEQ ID NO: 520 - protein, 25 aa, Artificial Sequence
  Made in a lab
VGEGLYQGVPRAEPGTEARRHYDEG

SEQ ID NO: 521 - protein, 21 aa, Artificial Sequence
  Made in a lab
APFPNGHVGAGGSGLLPPPPA

SEQ ID NO: 522 - protein, 20 aa, Artificial Sequence
  Made in a lab
LLVVPAIKKDYGSQEDFTQV

SEQ ID NO: 523 - protein, 254 aa, Artificial Sequence
  Made in a lab
  VARIANT (1)...(254): Xaa = any amino acid
MATAGNPWGWFLGYLILGVAGSLVSGSCSQIINGEDCSPHSQPWQAALVMENELFCSGVLVHPQWVLSATHCFQNSYTIGLGLHSLEADQEPGSQMVEASLSVRHPEYNRPLLANDLMLIKLDESVSESDTIRSISIASQCPTAGNSCLVSGWGLLANGRMPTVLQCVNVSVVSEEVCSKLYDPLYHPSMFCAGGGQXQXDSCNGDSGGPLICNGYLQGLVSFGKAPCGQVGVPGVYTNLCKFTEWIEKTVQAS

SEQ ID NO: 524 - DNA, 765 bp, Homo sapien
atggccacagcaggaaatccctggggctggttcctggggtacctcatccttggtgtcgcaggatcgctcgtctctggtagctgcagccaaatcataaacggcgaggactgcagcccgcactcgcagccctggcaggcggcactggtcatggaaaacgaattgttctgctcgggcgtcctggtgcatccgcagtgggtgctgtcagccgcacactgtttccagaactcctacaccatcgggctgggcctgcacagtcttgaggccgaccaagagccagggagccagatggtggaggccagcctctccgtacggcacccagagtacaacagacccttgctcgctaacgacctcatgctcatcaagttggacgaatccgtgtccgagtctgacaccatccggagcatcagcattgcttcgcagtgccctaccgcggggaactcttgcctcgtttctggctggggtctgctggcgaacggcagaatgcctaccgtgctgcagtgcgtgaacgtgtcggtggtgtctgaggaggtctgcagtaagctctatgacccgctgtaccaccccagcatgttctgcgccggcggagggcaagaccagaaggactcctgcaacggtgactctggggggcccctgatctgcaacgggtacttgcagggccttgtgtctttcggaaaagccccgtgtggccaagttggcgtgccaggtgtctacaccaacctctgcaaattcactgagtggatagagaaaaccgtccaggccagttaa

SEQ ID NO: 525 - protein, 254 aa, Homo sapien
MATAGNPWGWFLGYLILGVAGSLVSGSCSQIINGEDCSPHSQPWQAALVMENELFCSGVLVHPQWVLSAAHCFQNSYTIGLGLHSLEADQEPGSQMVEASLSVRHPEYNRPLLANDLMLIKLDESVSESDTIRSISIASQCPTAGNSCLVSGWGLLANGRMPTVLQCVNVSVVSEEVCSKLYDPLYHPSMFCAGGGQDQKDSCNGDSGGPLICNGYLQGLVSFGKAPCGQVGVPGVYTNLCKFTEWIEKTVQAS

SEQ ID NO: 526 - DNA, 963 bp, Homo sapiens
atgagttcctgcaacttcacacatgccacctttgtgcttattggtatcccaggattagagaaagcccatttctgggttggcttccccctcctttccatgtatgtagtggcaatgtttggaaactgcatcgtggtcttcatcgtaaggacggaacgcagcctgcacgctccgatgtacctctttctctgcatgcttgcagccattgacctggccttatccacatccaccatgcctaagatccttgcccttttctggtttgattcccgagagattagctttgaggcctgtcttacccagatgttctttattcatgccctctcagccattgaatccaccatcctgctggccatggcctttgaccgttatgtggccatctgccacccactgcgccatgctgcagtgctcaacaatacagtaacagcccagattggcatcgtggctgtggtccgcggatccctcttttttttcccactgcctctgctgatcaagcggctggccttctgccactccaatgtcctctcgcactcctattgtgtccaccaggatgtaatgaagttggcctatgcagacactttgcccaatgtggtatatggtcttactgccattctgctggtcatgggcgtggacgtaatgttcatctccttgtcctattttctgataatacgaacggttctgcaactgccttccaagtcagagcgggccaaggcctttggaacctgtgtgtcacacattggtgtggtactcgccttctatgtgccacttattggcctctcagttgtacaccgctttggaaacagccttcatcccattgtgcgtgttgtcatgggtgacatctacctgctgctgcctcctgtcatcaatcccatcatctatggtgccaaaaccaaacagatcagaacacgggtgctggctatgttcaagatcagctgtgacaaggacttgcaggctgtgggaggcaagtga

SEQ ID NO: 527 - protein, 320 aa, Homo sapiens
MSSCNFTHATFVLIGIPGLEKAHFWVGFPLLSMYVVAMFGNCIVVFIVRTERSLHAPMYLFLCMLAAIDLALSTSTMPKILALFWFDSREISFEACLTQMFFIHALSAIESTILLAMAFDRYVAICHPLRHAAVLNNTVTAQIGIVAVVRGSLFFFPLPLLIKRLAFCHSNVLSHSYCVHQDVMKLAYADTLPNVVYGLTAILLVMGVDVMFISLSYFLIIRTVLQLPSKSERAKAFGTCVSHIGVVLAFYVPLIGLSVVHRFGNSLHPIVRVVMGDIYLLLPPVINPIIYGAKTKQIRTRVLAMFKISCDKDLQAVGGK

SEQ ID NO: 528 - DNA, 20 bp, Homo Sapien
actatggtccagaggctgtg

SEQ ID NO: 529 - DNA, 20 bp, Homo Sapien
atcacctatgtgccgcctct

SEQ ID NO: 530 - DNA, 1852 bp, Homo sapiens
ggcacgagaattaaaaccctcagcaaaacaggcatagaagggacataccttaaagtaataaaaaccacctatgacaagcccacagccaacataatactaaatggggaaaagttagaagcatttcctctgagaactgcaacaataaatacaaggatgctggattttgtcaaatgccttttctgtgtctgttgagatgcttatgtgactttgcttttaattctgtttatgtgattatcacatttattgacttgcctgtgttagaccggaagagctggggtgtttctcaggagccaccgtgtgctgcggcagcttcgggataacttgaggctgcatcactggggaagaaacacaytcctgtccgtggcgctgatggctgaggacagagcttcagtgtggcttctctgcgactggcttcttcggggagttcttccttcatagttcatccatatggctccagaggaaaattatattattttgttatggatgaagagtattacgttgtgcagatatactgcagtgtcttcatctcttgatgtgtgattgggtaggttccaccatgttgccgcagatgacatgatttcagtacctgtgtctggctgaaaagtgtttgtttgtgaatggatattgtggtttctggatctcatcctctgtgggtggacagctttctccaccttgctggaagtgacctgctgtccagaagtttgatggctgaggagtataccatcgtgcatgcatctttcatttcctgcatttcttcctccctggatggacagggggagcggcaagagcaacgtgggcacttctggagaccacaacgactcctctgtgaagacgcttgggagcaagaggtgcaagtggtgctgccactgcttcccctgctgcagggggagcggcaagagcaacgtggtcgcttggggagactacgatgacagcgccttcatggatcccaggtaccacgtccatggagaagatctggacaagctccacagagctgcctggtggggtaaagtccccagaaaggatctcatcgtcatgctcagggacacggatgtgaacaagagggacaagcaaaagaggactgctctacatctggcctctgccaatgggaattcagaagtagtaaaactcgtgctggacagacgatgtcaacttaatgtccttgacaacaaaaagaggacagctctgacaaaggccgtacaatgccaggaagatgaatgtgcgttaatgttgctggaacatggcactgatccaaatattccagatgagtatggaaataccactctacactatgctgtctacaatgaagataaattaatggccaaagcactgctcttatacggtgctgatatcgaatcaaaaaacaagcatggcctcacaccactgctacttggtatacatgagcaaaaacagcaagtggtgaaatttttaatcaagaaaaaagcgaatttaaatgcgctggatagatatggaagaactgctctcatacttgctgtatgttgtggatcagcaagtatagtcagccctctacttgagcaaaatgttgatgtatcttctcaagatctggaaagacggccagagagtatgctgtttctagtcatcatcatgtaatttgccagttactttctgactacaaagaaaaacagatgttaaaaatctcttctgaaaacagcaatccagaacaagacttaaagctgacatcagaggaagagtcacaaaggcttaaaggaagtgaaaacagccagccagagctagaagatttatggctattgaagaagaatgaagaacacggaagtactcatgtgggattcccagaaaacctgactaacggtgccgctgctggcaatggtgatga

SEQ ID NO: 531 - DNA, 879 bp, Homo sapiens
atgcatctttcatttcctgcatttcttcctccctggatggacagggggagcggcaagagcaacgtgggcacttctggagaccacaacgactcctctgtgaagacgcttgggagcaagaggtgcaagtggtgctgccactgcttcccctgctgcagggggagcggcaagagcaacgtggtcgcttggggagactacgatgacagcgccttcatggatcccaggtaccacgtccatggagaagatctggacaagctccacagagctgcctggtggggtaaagtccccagaaaggatctcatcgtcatgctcagggacacggatgtgaacaagagggacaagcaaaagaggactgctctacatctggcctctgccaatgggaattcagaagtagtaaaactcgtgctggacagacgatgtcaacttaatgtccttgacaacaaaaagaggacagctctgacaaaggccgtacaatgccaggaagatgaatgtgcgttaatgttgctggaacatggcactgatccaaatattccagatgagtatggaaataccactctacactatgctgtctacaatgaagataaattaatggccaaagcactgctcttatacggtgctgatatcgaatcaaaaaacaagcatggcctcacaccactgctacttggtatacatgagcaaaaacagcaagtggtgaaatttttaatcaagaaaaaagcgaatttaaatgcgctggatagatatggaagaactgctctcatacttgctgtatgttgtggatcagcaagtatagtcagccctctacttgagcaaaatgttgatgtatcttctcaagatctggaaagacggccagagagtatgctgtttctagtcatcatcatgtaa

SEQ ID NO: 532 - protein, 292 aa, Homo sapiens
MHLSFPAFLPPWMDRGSGKSNVGTSGDHNDSSVKTLGSKRCKWCCHCFPCCRGSGKSNVVAWGDYDDSAFMDPRYHVHGEDLDKLHRAAWWGKVPRKDLIVMLRDTDVNKRDKQKRTALHLASANGNSEVVKLVLDRRCQLNVLDNKKRTALTKAVQCQEDECALMLLEHGTDPNIPDEYGNTTLHYAVYNEDKLMAKALLLYGADIESKNKHGLTPLLLGIHEQKQQVVKFLIKKKANLNALDRYGRTALILAVCCGSASIVSPLLEQNVDVSSQDLERRPESMLFLVIIM

SEQ ID NO: 533 - DNA, 801 bp, Homo sapiens
atgtacaagcttcagtgcaacaactgtgctacaaatggagccacagagaggaaacaagcagcaggctcaggagcagggtatgcgctgccttcggctctccaatccatgcctcagggctcctatgccactgcacgattcttggttgccaagaggccaaccacaggccatcttgagaaggagtttatgttccactgcagaaagcagccaggatcaccatccaggggacttggtcttctgtggccctggccagacatagaatttgtgccaaggcaggacaagctcactcagagcagcgtgttagtacctcaaatctgtgcgtgccagacaaggccaaactggctcaatgagcaaccagccacctctgcaggggtgcgtctggaggaggtggaccagccaccaaccttacccagtcaaggaagtggatggccatgttcccacagcctgagtggctgccacctgatggctgatatagcaaaggccttaggaaaagcagatggcccttggccctacctttttgttagaagaactgatgttccatgtcctgcagcgagtgaggttggtggctgtgcccccagctcctggcacaccctcgcagaggtgactggttgctctttgagccctcttagccttgcccagcatgcacaagcctcagtgctactactgtgctacaaatggagccatataggggaaacgagcagccatctcaggagcaaggtgtatgctgcctttgggggctccagtccttgcctcaagggtcttatgtcactgtgggcttcttggttgccaagaggcagaccatag

SEQ ID NO: 534 - protein, 266 aa, Homo sapiens [sequence omitted]

SEQ ID NO: 535 - DNA, 6082 bp, Homo sapiens
cctccactattacagcttataggaaattacaatccactttacaggcctcaaaggttcattctggccgagcggacaggcgtggcggccggagccccagcatccctgcttgaggtccaggagcggagcccgcggccactgccgcctgatcagcgcgaccccggcccgcgcccgccccgcccggcaagatgctgcccgtgtaccaggaggtgaagcccaacccgctgcaggacgcgaacctctgctcacgcgtgttcttctggtggctcaatcccttgtttaaaattggccataaacggagattagaggaagatgatatgtattcagtgctgccagaagaccgctcacagcaccttggagaggagttgcaagggttctgggataaagaagttttaagagctgagaatgacgcacagaagccttctttaacaagagcaatcataaagtgttactggaaatcttatttagttttgggaatttttacgttaattgaggaaagtgccaaagtaatccagcccatatttttgggaaaaattattaattattttgaaaattatgatcccatggattctgtggctttgaacacagcgtacgcctatgccacggtgctgactttttgcacgctcattttggctatactgcatcacttatatttttatcacgttcagtgtgctgggatgaggttacgagtagccatgtgccatatgatttatcggaaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgatcgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgggaaaagtcattttcaaatcttattaccaatttgagaaagaaggagatttccaagattctgagaagttcctgcctcagggggatgaatttggcttcgtttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatacgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatacagagaatgtcccagttacactatcagaggagaaccgttctgaaggaaaagttggttttcaggcctataagaattacttcagagctggtgctcactggattgtcttcattttccttattctcctaaacactgcagctcaggttgcctatgtgcttcaagattggtggctttcatactgggcaaacaaacaaagtatgctaaatgtcactgtaaatggaggaggaaatgtaaccgagaagctagatcttaactggtacttaggaatttattcaggtttaactgtagctaccgttctttttggcatagcaagatctctattggtattctacgtccttgttaactcttcacaaactttgcacaacaaaatgtttgagtcaattctgaaagctccggtattattctttgatagaaatccaataggaagaattttaaatcgtttctccaaagacattggacacttggatgatttgctgccgctgacgtttttagatttcatccagacattgctacaagtggttggtgtggtctctgtggctgtggccgtgattccttggatcgcaatacccttggttccccttggaatcattttcatttttcttcggcgatattttttggaaacgtcaagagatgtgaagcgcctggaatctacaactcggagtccagtgttttcccacttgtcatcttctctccaggggctctggaccatccgggcatacaaagcagaagagaggtgtcaggaactgtttgatgcacaccaggatttacattcagaggcttggttcttgtttttgacaacgtcccgctggttcgccgtccgtctggatgccatctgtgccatgtttgtcatcatcgttgcctttgggtccctgattctggcaaaaactctggatgccgggcaggttggtttggcactgtcctatgccctcacgctcatggggatgtttcagtggtgtgttcgacaaagtgctgaagttgagaatatgatgatctcagtagaaagggtcattgaatacacagaccttgaaaaagaagcaccttgggaatatcagaaacgcccaccaccagcctggccccatgaaggagtgataatctttgacaatgtgaacttcatgtacagtccaggtgggcctctggtactgaagcatctgacagcactcattaaatcacaagaaaaggttggcattgtgggaagaaccggagctggaaaaagttccctcatctcagccctttttagattgtcagaacccgaaggtaaaatttggattgataagatcttgacaactgaaattggacttcacgatttaaggaagaaaatgtcaatcatacctcaggaacctgttttgttcactggaacaatgaggaaaaacctggatccctttaatgagcacacggatgaggaactgtggaatgccttacaagaggtacaacttaaagaaaccattgaagatcttcctggtaaaatggatactgaattagcagaatcaggatccaattttagtgttggacaaagacaactggtgtgccttgccagggcaattctcaggaaaaatcagatattgattattgatgaagcgacggcaaatgtggatccaagaactgatgagttaatacaaaaaaaatccgggagaaatttgcccactgcaccgtgctaaccattgcacacagattgaacaccattattgacagcgacaagataatggttttagattcaggaagactgaaagaatatgatgagccgtatgttttgctgcaaaataaagagagcctattttacaagatggtgcaacaactgggcaaggcagaagccgctgccctcactgaaacagcaaaacaggtatacttcaaaagaaattatccacatattggtcacactgaccacatggttacaaacacttccaatggacagccctcgaccttaactattttcgagacagcactgtgaatccaaccaaaatgtcaagtccgttccgaaggcatttgccactagtttttggactatgtaaaccacattgtacttttttttactttggcaacaaatatttatacatacaagatgctagttcatttgaatatttctcccaacttatccaaggatctccagctctaacaaaatggtttatttttatttaaatgtcaatagttgttttttaaaatccaaatcagaggtgcaggccaccagttaaatgccgtctatcaggttttgtgccttaagagactacagagtcaaagctcatttttaaaggagtaggacagagttgtcacaggtttttgttgttgtttttattgcccccaaaattacatgttaatttccatttatatcagggattctatttacttgaagactgtgaagttgccattttgtctcattgttttctttgacataactaggatccattatttcccctgaaggcttcttgttagaaaatagtacagttacaaccaataggaacaacaaaaagaaaaagtttgtgacattgtagtagggagtgtgtaccccttactccccatcaaaaaaaaaaatggatacatggttaaaggatagaagggcaatattttatcatatgttctaaaagagaaggaagagaaaatactactttctcaaaatggaagcccttaaaggtgctttgatactgaaggacacaaatgtgaccgtccatcctcctttagagttgcatgacttggacacggtaactgttgcagttttagactcagcattgtgacacttcccaagaaggccaaacctctaaccgacattcctgaaatacgtggcattattcttttttggatttctcatttatggaaggctaaccctctgttgactgtaagccttttggtttgggctgtattgaaatcctttctaaattgcatgaataggctctgctaacgtgatgagacaaactgaaaattattgcaagcattgactataattatgcagtacgttctcaggatgcatccaggggttcattttcatgagcctgtccaggttagtttactcctgaccactaatagcattgtcatttgggctttctgttgaatgaatcaacaaaccacaatacttcctgggaccttttgtactttatttgaactatgagtctttaatttttcctgatgatggtggctgtaatatgttgagttcagtttactaaaggttttactattatggtttgaagtggagtctcatgacctctcagaataaggtgtcacctccctgaaattgcatatatgtatatagacatgcacacgtgtgcatttgtttgtatacatatatttgtccttcgtatagcaagttttttgctcatcagcagagagcaacagatgttttattgagtgaagccttaaaaagcacacaccacacacagctaactgccaaaatacattgaccgtagtagctgttcaactcctagtacttagaaatacacgtatggttaatgttcagtccaacaaaccacacacagtaaatgtttattaatagtcatggttcgtattttaggtgactgaaattgcaacagtgatcataatgaggtttgttaaaatgatagctatattcaaaatgtctatatgtttatttggacttttgaggttaaagacagtcatataaacgtcctgtttctgttttaatgttatcatagaattttttaatgaaactaaattcaattgaaataaatgatagttttcatctccaaaaaaaaaaaaaaaaagggcggccgctcgagtctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatc

SEQ ID NO: 536 - DNA, 6140 bp, Homo sapiens
  misc_feature (1)...(6140): n=A,T,C or G
cagtggcgcagtctcagctcactgcagcctccacctcctgtgttcaagcagtcctcctgcctcagccaccagactagcaggtctcccccgcctctttcttggaaggacacttgccattggatttaggacccacttggataatccaggatgatgtcttcactccaacatcctcagtttaattccatgtgcaaatacccttttcccaaataacattcaattctttaccaggaaaggtggctcaatcccttgtttaaaattggccataaacggagattagaggaagatgatatgtattcagtgctgccagaagaccgctcacagcaccttggagaggagttgcaagggttctgggataaagaagttttaagagctgagaatgacgcacagaagccttctttaacaagagcaatcataaagtgttactggaaatcttatttagttttgggaatttttacgttaattgaggaaagtgccaaagtaatccagcccatatttttgggaaaaattattaattattttgaaaattatgatcccatggattctgtggctttgaacacagcgtacgcctatgccacggtgctgactttttgcacgctcattttggctatactgcatcacttatatttttatcacgttcagtgtgctgggatgaggttacgagtagccatgtgccatatgatttatcggaaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgatcgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgggaaaagtcattttcaaatcttattaccaatttgagaaagaaggagatttccaagattctgagaagttcctgcctcagggggatgaatttggcttcgtttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatacgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatacagagaatgtcccagttacactatcagaggagaaccgttctgaaggaaaagttggttttcaggcctataagaattacttcagagctggtgctcactggattgtcttcattttccttattctcctaaacactgcagctcaggttgcctatgtgcttcaagattggtggctttcatactgggcaaacaaacaaagtatgctaaatgtcactgtaaatggaggaggaaatgtaaccgagaagctagatcttaactggtacttaggaatttattcaggtttaactgtagctaccgttctttttggcatagcaagatctctattggtattctacgtccttgttaactcttcacaaactttgcacaacaaaatgtttgagtcaattctgaaagctccggtattattctttgatagaaatccaataggaagaattttaaatcgtttctccaaagacattggacacttggatgatttgctgccgctgacgtttttagatttcatccagacattgctacaagtggttggtgtggtctctgtggctgtggccgtgattccttggatcgcaatacccttggttccccttggaatcattttcatttttcttcggcgatattttttggaaacgtcaagagatgtgaagcgcctggaatctacaactcggagtccagtgttttcccacttgtcatcttctctccaggggctctggaccatccgggcatacaaagcagaagagaggtgtcaggaactgtttgatgcacaccaggatttacattcagaggcttggttcttgtttttgacaacgtcccgctggttcgccgtccgtctggatgccatctgtgccatgtttgtcatcatcgttgcctttgggtccctgattctggcaaaaactctggatgccgggcaggttggtttggcactgtcctatgccctcacgctcatggggatgtttcagtggtgtgttcgacaaagtgctgaagttgagaatatgatgatctcagtagaaagggtcattgaatacacagaccttgaaaaagaagcaccttgggaatatcagaaacgcccaccaccagcctggccccatgaaggagtgataatctttgacaatgtgaacttcatgtacagtccaggtgggcctctggtactgaagcatctgacagcactcattaaatcacaagaaaaggttggcattgtgggaagaaccggagctggaaaaagttccctcatctcagccctttttagattgtcagaacccgaaggtaaaatttggattgataagatcttgacaactgaaattggacttcacgatttaaggaagaaaatgtcaatcatacctcaggaacctgttttgttcactggaacaatgaggaaaaacctggatccctttaatgagcacacggatgaggaactgtggaatgccttacaagaggtacaacttaaagaaaccattgaagatcttcctggtaaaatggatactgaattagcagaatcaggatccaattttagtgttggacaaagacaactggtgtgccttgccagggcaattctcaggaaaaatcagatattgattattgatgaagcgacggcaaatgtggatccaagaactgatgagttaatacaaaaaaaaatccgggagaaatttgcccactgcaccgtgctaaccattgcacacagattgaacaccattattgacagcgacaagataatggttttagattcaggaagactgaaagaatatgatgagccgtatgttttgctgcaaaataaagagagcctattttacaagatggtgcaacaactgggcaaggcagaagccgctgccctcactgaaacagcaaaacagagatggggtttcaccatgttggccaggctggtctcaaactcctgacctcaagtgatccacctgccttggcctcccaaactgctgagattacaggtgtgagccaccacgcccagcctgagtatacttcaaaagaaattatccacatattggtcacactgaccacatggttacaaacacttccaatggacagccctcgaccttaactattttcgagacagcactgtgaatccaaccaaaatgtcaagtccgttccgaaggcatttgccactagtttttggactatgtaaaccacattgtacttttttttactttggcaacaaatatttatacatacaagatgctagttcatttgaatatttctcccaacttatccaaggatctccagctctaacaaaatggtttatttttatttaaatgtcaatagtkgktttttaaaatccaaatcagaggtgcaggccaccagttaaatgccgtctatcaggttttgtgccttaagagactacagnagtcagaagctcatttttaaaggagtaggacagagttgtcacaggtttttgttggtgtttktattgcccccaaaattacatgttaatttccatttatatcaggggattctatttacttgaagactgtgaagttgccattttgtctcattgttttctttgacatamctaggatccattatttcccctgaaggcttcttgkagaaaatagtacagttacaaccaataggaactamcaaaaagaaaaagtttgtgacattgtagtagggagtgtgtaccccttactccccatcaaaaaaaaaaatggatacatggttaaaggatagaagggcaatattttatcatatgttctaaaagagaaggaagagaaaatactactttctcaaaatggaagcccttaaaggtgctttgatactgaaggacacaaatgtgaccgtccatcctcctttagagttgcatgacttggacacggtaactgttgcagttttagactcagcattgtgacacttcccaagaaggccaaacctctaaccgacattcctgaaatacgtggcattattcttttttggatttctcatttaggaaggctaaccctctgttgamtgtamkccttttggtttgggctgtattgaaatcctttctaaattgcatgaataggctctgctaaccgtgatgagacaaactgaaaattattgcaagcattgactataattatgcagtacgttctcaggatgcatccaggggttcattttcatgagcctgtccaggttagtttactcctgaccactaatagcattgtcatttgggctttctgttgaatgaatcaacaaaccacaatacttcctgggaccttttgtactttatttgaactatgagtctttaatttttcctgatgatggtggctgtaatatgttgagttcagtttactaaaggttttactattatggtttgaagggagtctcatgacctctcagaaaaggtgcacctccctgaaattgcatatatgtatatagacatgcacacgtgtgcatttgtttgtatacatatatttgtccttcgtatagcaagttttttgctcatcagcagagagcaacagatgttttattgagtgaagccttaaaaagcacacaccacacacagctaactgccaaaatacattgaccgtagtagctgttcaactcctagtacttagaaatacacgtatggttaatgttcagtccaacaaaccacacacagtaaatgtttattaatagtcatggttcgtattttaggtgactgaaattgcaacagtgatcataatgaggtttgttaaaatgatagctatattcaaaatgtctatatgtttatttggacttttgaggttaaagacagtcatataaacgtcctgtttctgttttaatgttatcatagaattttttaatgaaactaaattcaattgaaataaatgatagttttcatctccaaaaaaaaaaaaaaagggcggcccgctcgagtctagagggcccggtttaaacccgctgatcagcctcgactgtgccttctagttgccagccatctgttgtttggccctcccccgtgccttccttgaccctggaaggggccactccc

SEQ ID NO: 537 - protein, 1228 aa, Homo sapiens
MLPVYQEVKPNPLQDANLCSRVFFWWLNPLFKIGHKRRLEEDDMYSVLPEDRSQHLGEELQGFWDKEVLRAENDAQKPSLTRAIIKCYWKSYLVLGIFTLIEESAKVIQPIFLGKIINYFENYDPMDSVALNTAYAYATVLTFCTLILAILHHLYFYHVQCAGMRLRVAMCHMIYRKALRLSNMAMGKTTTGQIVNLLSNDVNKFDQVTVFLHFLWAGPLQAIAVTALLWMEIGISCLAGMAVLIILLPLQSCFGKLFSSLRSKTATFTDARIRTMNEVITGIRIIKMYAWEKSFSNLITNLRKKEISKILRSSCLRGMNLASFFSASKIIVFVTFTTYVLLGSVITASRVFVAVTLYGAVRLTVTLFFPSAIERVSEAIVSIRRIQTFLLLDEISQRNRQLPSDGKKMVHVQDFTAFWDKASETPTLQGLSFTVRPGELLAVVGPVGAGKSSLLSAVLGELAPSHGLVSVHGRIAYVSQQPWVFSGTLRSNILFGKKYEKERYEKVIKACALKKDLQLLEDGDLTVIGDRGTTLSGGQKARVNLARAVYQDADIYLLDDPLSAVDAEVSRHLFELCICQILHEKITILVTHQLQYLKAASQILILKDGKMVQKGTYTEFLKSGIDFGSLLKKDNEESEQPPVPGTPTLRNRTFSESSVWSQQSSRPSLKDGALESQDTENVPVTLSEENRSEGKVGFQAYKNYFRAGAHWIVFIFLILLNTAAQVAYVLQDWWLSYWANKQSMLNVTVNGGGNVTEKLDLNWYLGIYSGLTVATVLFGIARSLLVFYVLVNSSQTLHNKMFESILKAPVLFFDRNPIGRILNRFSKDIGHLDDLLPLTFLDFIQTLLQVVGVVSVAVAVIPWIAIPLVPLGIIFIFLRRYFLETSRDVKRLESTTRSPVFSHLSSSLQGLWTIRAYKAEERCQELFDAHQDLHSEAWFLFLTTSRWFAVRLDAICAMFVIIVAFGSLILAKTLDAGQVGLALSYALTLMGMFQWCVRQSAEVENMMISVERVIEYTDLEKEAPWEYQKRPPPAWPHEGVIIFDNVNFMYSPGGPLVLKHLTALIKSQEKVGIVGRTGAGKSSLISALFRLSEPEGKIWIDKILTTEIGLHDLRKKMSIIPQEPVLFTGTMRKNLDPFNEHTDEELWNALQEVQLKETIEDLPGKMDTELAESGSNFSVGQRQLVCLARAILRKNQILIIDEATANVDPRTDELIQKKSGRNLPTAPC

SEQ ID NO: 538 - protein, 1261 aa, Homo sapiens
MYSVLPEDRSQHLGEELQGFWDKEVLRAENDAQKPSLTRAIIKCYWKSYLVLGIFTLIEESAKVIQPIFLGKIINYFENYDPMDSVALNTAYAYATVLTFCTLILAILHHLYFYHVQCAGMRLRVAMCHMIYRKALRLSNMAMGKTTTGQIVNLLSNDVNKFDQVTVFLHFLWAGPLQAIAVTALLWMEIGISCLAGMAVLIILLPLQSCFGKLFSSLRSKTATFTDARIRTMNEVITGIRIIKMYAWEKSFSNLITNLRKKEISKILRSSCLRGMNLASFFSASKIIVFVTFTTYVLLGSVITASRVFVAVTLYGAVRLTVTLFFPSAIERVSEAIVSIRRIQTFLLLDEISQRNRQLPSDGKKMVHVQDFTAFWDKASETPTLQGLSFTVRPGELLAVVGPVGAGKSSLLSAVLGELAPSHGLVSVHGRIAYVSQQPWVFSGTLRSNILFGKKYEKERYEKVIKACALKKDLQLLEDGDLTVIGDRGTTLSGGQKARVNLARAVYQDADIYLLDDPLSAVDAEVSRHLFELCICQILHEKITILVTHQLQYLKAASQILILKDGKMVQKGTYTEFLKSGIDFGSLLKKDNEESEQPPVPGTPTLRNRTFSESSVWSQQSSRPSLKDGALESQDTENVPVTLSEENRSEGKVGFQAYKNYFRAGAHWIVFIFLILLNTAAQVAYVLQDWWLSYWANKQSMLNVTVNGGGNVTEKLDLNWYLGIYSGLTVATVLFGIARSLLVFYVLVNSSQTLHNKMFESILKAPVLFFDRNPIGRILNRFSKDIGHLDDLLPLTFLDFIQTLLQVVGVVSVAVAVIPWIAIPLVPLGIIFIFLRRYFLETSRDVKRLESTTRSPVFSHLSSSLQGLWTIRAYKAEERCQELFDAHQDLHSEAWFLFLTTSRWFAVRLDAICAMFVIIVAFGSLILAKTLDAGQVGLALSYALTLMGMFQWCVRQSAEVENMMISVERVIEYTDLEKEAPWEYQKRPPPAWPHEGVIIFDNVNFMYSPGGPLVLKHLTALIKSQEKVGIVGRTGAGKSSLISALFRLSEPEGKIWIDKILTTEIGLHDLRKKMSIIPQEPVLFTGTMRKNLDPFNEHTDEELWNALQEVQLKETIEDLPGKMDTELAESGSNFSVGQRQLVCLARAILRKNQILIIDEATANVDPRTDELIQKKIREKFAHCTVLTIAHRLNTIIDSDKIMVLDSGRLKEYDEPYVLLQNKESLFYKMVQQLGKAEAAALTETAKQRWGFTMLARLVSNS

SEQ ID NO: 539 - protein, 10 aa, Artificial Sequence
  Made in a lab
CLSHSVAVVT

SEQ ID NO: 540 - protein, 9 aa, Artificial Sequence
  Made in a lab
AVVTASAAL

SEQ ID NO: 541 - protein, 14 aa, Homo sapiens
LAGLLCPDPRPLEL

SEQ ID NO: 542 - protein, 15 aa, Homo sapiens
TQVVFDKSDLAKYSA

SEQ ID NO: 543 - protein, 12 aa, Homo sapiens
FMGSIVQLSQSV

SEQ ID NO: 544 - protein, 18 aa, Homo sapiens
TYVPPLLLEVGVEEKFMT

SEQ ID NO: 545 - protein, 18 aa, Homo sapiens
MDRLVQRFGTRAVYLASV

SEQ ID NO: 546 - protein, 29 aa, Homo sapiens
FVGEGLYQGVPRAEPGTEARRHYDEGVRM

SEQ ID NO: 547 - protein, 58 aa, Homo sapiens
VAEEAALGPTEPAEGLSAPSLSPHCCPCRARLAFRNLGALLPRLHQLCCRMPRTLRRL

SEQ ID NO: 548 - protein, 18 aa, Homo sapiens
IDWDTSALAPYLGTQEEC

SEQ ID NO: 549 - protein, 18 aa, Homo sapiens
LEALLSDLFRDPDHCRQA

SEQ ID NO: 550 - protein, 14 aa, Homo sapiens
SDHWRGRYGRRRPF

SEQ ID NO: 551 - protein, 11 aa, Artificial Sequence
  Made in a lab
FDKSDLAKYSA

SEQ ID NO: 552 - DNA, 2577 bp, Homo sapiens
agcatatgtaacatgacctgtgcttcagtgttcttttgtgatcaaaaattccttacttttagttttttatctatggtagaaccacccagagcaggggtcctcaactcccaggccacagactcataccagtccacggactattatgaaccacaccacacaggaggaggtgagcactaggcaagccaaggaagcttcacctgtacttacagccacacgccatggctcatattacagcctgaactctgcctccactcagatcagtgataacattagaaactcattggagcacgaaccctgttgtgaactgcctatccgaaggatctaggttgtgtgcttcgtatgagaatctaatgccagatgatctatcattgtctcactttgcccccagataagaccatctagttgcagaaaaataagctcagagcttccactgattctacattatggatatgtgccgccgaagcaagcacaaagccctacttttacacatgcctagtgatgcttcatggacaaggcttggctctgttgagtccaactaacctacctgagattctgagatttctcttcaatggcttcctgtgagctagagtttgaaaatatcttaaaatcttgagctagagatggaagtagcttggacgattttcattatcatgtaaatcgggtcactcaaggggccaaccacagctgggagccactgctcaggggaaggttcatatgggactttctactgcccaaggttctatacaggatataaaggtgcctcacagtatagatctggtagcaaagaagaagaaacaaacactgatctctttctgccacccctctgaccctttggaactcctctgaccctttagaacaagcctacctaatatctgctagagaaaagaccaacaacggcctcaaaggatctcttaccatgaaggtctcagctaattcttggctaagatgtgggttccacattaggttctgaatatggggggaagggtcaatttgctcattttgtgtgtggataaagtcaggatgcccaggggccagagcagggggctgctgctttgggaacaatggctgagcatataaccataggtatgggaacaaaaaacatcaaagtcactgtatcaattgccatgaagactcgagggacctgaatctaccgattcatcttaaggcagcaggaccagtttgagtggcaacaatgcagcagcagaatcaatggaaacaacagaatgattgcaatgtccttttttttctcctccttctgacttgataaaagggaccgtcttccttggatttagtgaacccctttggttcctgaaaaattcaaggagtatctaggacatagtccccagaagacagtacaagactttctgataaactggacatttcaagrcccaaataactaatcagaaaaatcaaagatgtgatactattttttatcccatgcataggtgctacacttggatcaaatgaacaatgttgggatctytatggataaaggtcttaaaagtcctgagataaagaatcctgcacccactggtacttctaacttgtcttgttttttgtctgwtttctggctgatgcaggggactaactcactgccacgcgaaaactacctgaactgaactatgacatctcacctgatatgtaagatgtaactgttataattattttaaacctcaatttagcattaactagccttttaatgtaaacacttacacattatgaygactagaaacagcatactctctggccgtctgtccagatagatcttgagaagatacatcaatgttttgctcaagtagaaggctgactatacttgccgatccacaacatacagcaagtatgagagcagttctaaaatgacagagataggaacagtaataaagttattktaaaagctaatttgatatactttaccaatttaacatcttgcctgtccgtgcagaatcaaacatttacatgcactaaaagacataagcatcttcagtgctcaagtgttcatctttgtaaaataccaccaaggttaaaaggaagggacaaaaaaaaaaaaccctcttatctcagtggggtattgcatagcagaagctactaatttgaagtcctttgatggacaagaaacaatattagggccacttatctgaaatgaacaaagatttaagtgaagatttcatcacagcttccctagactgatatgctgtaatagaaaatcagctagggggtaaaataaataagagctctctgcatgctgaaagcaagtaagattaataataatggtaagaatagtagtcacaggagtttcagttaatgatgccaataagcatgtgctaggcactgaattaaatgccacatatatctttcttatgcgcagcaaactttgaaggatatattctcctacttttcatatatgacaacatatttggtggtaaataacgttcccaaggtcacacacctagcaagtaagaaagttaggaattaaacccagtattgtgtgaatctaaagcctaacttttttctctttatcacccacctacggcttgtcttcattaaaggaaaagtgtatccacttaaaaaaaaaaaaaa

SEQ ID NO: 553 - protein, 58 aa, Homo sapiens
SICNMTCASVFFCDQKFLTFSFLSMVEPPRAGVLNSQATDSYQSTDYYEPHHTGGGEH

SEQ ID NO: 554 - protein, 59 aa, Homo sapiens
LQKNKLRASTDSTLWICAAEASTKPYFYTCLVMLHGQGLALLSPTNLPEILRFLFNGFL

SEQ ID NO: 555 - protein, 71 aa, Homo sapiens
LGRFSLSCKSGHSRGQPQLGATAQGKVHMGLSTAQGSIQDIKVPHSIDLVAKKKKQTLISFCHPSDPLELL

SEQ ID NO: 556 - protein, 81 aa, Homo sapiens
NHPEQGSSTPRPQTHTSPRTIMNHTTQEEVSTRQAKEASPVLTATRHGSYYSLNSASTQISDNIRNSLEHEPCCELPIRRI

SEQ ID NO: 557 - protein, 54 aa, Homo sapiens
SLSATPLTLWNSSDPLEQAYLISAREKTNNGLKGSLTMKVSANSWLRCGFHIRF

SEQ ID NO: 558 - protein, 77 aa, Homo sapiens
  VARIANT (1)...(77): Xaa = Any amino acid
NDRDRNSNKVIXKANLIYFTNLTSCLSVQNQTFTCTKRHKHLQCSSVHLCKIPPRLKGRDKKKKPSYLSGVLHSRSY

SEQ ID NO: 559 - protein, 50 aa, Homo sapiens
TLPPLRSVITLETHWSTNPVVNCLSEGSRLCASYENLMPDDLSLSHFAPR

SEQ ID NO: 560 - protein, 56 aa, Homo sapiens
IGSLKGPTTAGSHCSGEGSYGTFYCPRFYTGYKGASQYRSGSKEEETNTDLFLPPL

SEQ ID NO: 561 - protein, 57 aa, Homo sapiens
  VARIANT (1)...(57): Xaa = Any amino acid
VLHLDQMNNVGIXMDKGLKSPEIKNPAPTGTSNLSCFLSXFWLMQGTNSLPRENYLN

SEQ ID NO: 562 - protein, 59 aa, Homo sapiens
  VARIANT (1)...(59): Xaa = Any amino acid
DLYPXRSQHCSFDPSVAPMHGIKNSITSLIFLISYLXLEMSSLSESLVLSSGDYVLDTP

SEQ ID NO: 563 - protein, 79 aa, Homo sapiens
CFLFPYLWLYAQPLFPKQQPPALAPGHPDFIHTQNEQIDPSPHIQNLMWNPHLSQELAETFMVRDPLRPLLVFSLADIR

SEQ ID NO: 564 - protein, 64 aa, Homo sapiens
ACSKGSEEFQRVRGVAERDQCLFLLLCYQIYTVRHLYILYRTLGSRKSHMNLPLSSGSQLWLAP

SEQ ID NO: 565 - protein, 57 aa, Homo sapiens
  VARIANT (1)...(57): Xaa = Any amino acid
LYYCSYLCHFRTALILAVCCGSASIVSLLLEQNIDVSSQDLSGQTAREYAVSSXHNV

SEQ ID NO: 566 - protein, 55 aa, Homo sapiens
ILLEFFRNQRGSLNPRKTVPFIKSEGGEKKGHCNHSVVSIDSAAALLPLKLVLLP

SEQ ID NO: 567 - protein, 51 aa, Homo sapiens
YSDFDVFCSHTYGYMLSHCSQSSSPLLWPLGILTLSTHKMSKLTLPPIFRT

SEQ ID NO: 568 - protein, 75 aa, Homo sapiens
KVGEYILQSLLRIRKIYVAFNSVPSTCLLASLTETPVTTILTIIINLTCFQHAESSYLFYPLADFLLQHISLGKL

SEQ ID NO: 569 - DNA, 4809 bp, Homo sapiens
gcatccagagtggtggactggttacaggctatgaacctacactgatgcggcaccaccacccagagtccacrggttatgttggttcacatttactcttgctgtggtatggtctataggtttggacagatgtccgataatcctttttacattttggcatccttgggtagctcgtcttgtaggaatggacttgcttcaaagtggaggcaggcagatccttcagacgggtatatggagccctgttttcagttgcttttctaattctctcttatcgtttacctcaaaatcttcctgaggtctcgcttccttttaaaatccttgtctactttgcagcatcactctgacactcccattgattcctcagcacctactgactacacggttaggagtgcaagggtagaattcatgttttattcatctttgggtctgtagcacccagcaaagtgctcagtaaatgcgcagtaattgatttgacctctgaacaaatacacactgtactaagaatctacacaccgaaagacaaaaacaagacaaatttgagtgctacaggtgtcacgcttggcatcacacatgtgcctgtgtattcctctaggtggttaccaggagctctgccactgcatgtccactagtgacgggttcgctccaccaccccagctgggtagccgctgctctcacataaggggtccaattaaaattgccaggaataaattcccccggactttgacttctcaagagctaagaaggtttgctgagtattctggcatgatgtttggtgatcaaacaactgctggccaaaaatgatgagtatttccccctcttgctgaagatgtgctccatacaatagtccatcacattcatcattcatcagtctggaagtgtgcagaacaacatgtaatagataatatgattggctgcacacttccagactgatgaatgatgaatgtgatggactattgtatggagcacatcttcagcaagagggggaaatactcatcattttatctattacatgttgttctggtttttttttttttccaatgtccagcctaaactataaagtactttgagaacgcacagtgagccataagcttgccaataaagagtcctctgtggtatggaactggcttatttcatacacaatctgcaaacaatgagggcactattggaaacatactgtgctgcacagagcatttacaccgcttatctttaatcttccccagcaatccttgctttgtgcgcatttatgatccttgctctcagaagtccacatacttttccccaaccgtaacaaattatttaactcatctaatgtatgtatgtccgcgcagtctgaaaacagtaattgtccttgggaagaagtgagtttaagagagctctagggcactcatcacaactccagccctgccctccatgtggtagcagctctttggactggggctaagtgcttattcttgtgcttcattcctggtaagctcaatttctttaccttaggataactttgctggaaaagggctcagattcagccgaccattgtggcctctgtggctgtcacagcttgtccctgacatgctatgatgttgggtccccttctcatccccttgggatttcttctgctggcccacagccagaacaactaggccttttactccaccatccctttgttttcttttgtttcgttggtaaaaatcaatccttctaccatccatgcatagcaatttctaaaaactgaatttcaagagcagtatctgaagaaacaaacatgatttggtccttttagtaaacagaataaattttaataaatcaactttgaaatagttgtaagagttaagaaaaagcacaaaactgagatcatcagagcagcttggcctcaaaggacaggcagcaggattctacagggtttgagccttcctaagtgaagctgtttcctgcaggctccctgctccaagctcctagctaacagccccttctcccacgattggcaacaaagagcaaaaataactttgtacttgatgctgagtcagtgtaaaaagccataaaaaattccctctaaatgtcaaaatgtttgcctcctttgaggcttctctcctcctactgggtctggataaattagcactgggcttatattgagtcacagatctgggccctgccacagagagcttcctcctagtgtgtgatgctttttctccaaactattgatacaaaatgcactggaatagaaatcaacagaaactggtcaaaggtgtggcatacacattctcatgtagatgtaaagctgtgcttagaattcctttgtggagtctggtttggtcttggttttcttggtgtttgattcatttttttacgtaaattacaaaaaccctccacatttcttcatggattgtattagtccatgttctccagagaagcagaacgagttggatgtatgttttggaagagattatgaggaaccggctcatgtgatgaaggaggttgagaggtcctgtgctctgccatctgcaagctgaagacctggaaagctgagggtgtggctccagtctgagtctgaaggcccaagaaccaggggaaccaacggtgtagattccaggttgaaggcaggagaagatggatgtcccagctcagcaggcaggcaggaagcaaatggggtaaattcctccttcctccaccttttgttccattcaggccttcaacagattggatgagcgcccccccacccccacactagggagggccatctgctttactgagtcggctgagtcaagtgccagcctcatcccaaaacactctccagacacacgcagaaatgtttcatctgggcaccctgtggccagtcatgctgacacacagaactaaccatgacatggattcttcttaaagcagtgataggagcgaacagaaacattttcataattttcaattatttttaatgaaaactatatctgatggaattgtttaaacctagtctggccacacattatttcctgggaccgcccctccttcaatcccttggacactgatgactttatgcccagattacactggaggcctgtgctgattttctaacacatacctgcaactgagctggcaaaaagaaaactaggcaagtatgacagatacatgatgcacaggctaagtgcaaaggaaagaaaaacaccaactgcagggatgagggactcacccctttagaagtttctacttgagcagctagaagactacaatgccactcatcaaaacagtgactcagggggagtatttgggataaaggaggaatctgatgttggaggtcaaatttgaagtgtctttaagacctacaggtaacgagacagctggacaaacacatggaactcaggacaaaggctctaaggacagcacagcagctgacatcctgtgtgacagccttgaaagcagcaggcccgccgctcacattttggaagggaaaatgggtacaatgttgtctgccactttggggccttcttgggtcacatgcattttacatttatgcagttgatatatttatgtttcctgggtcttttatacattagacaccatgattctcaatcctttgttattttgtattacaaaaagctgaattattatttcaaatatgggcaaattagagccttccatattgccaaggtgtatcaaccacactgataycaygatctctcttttgaattagttttccagttcacacctaccatttatttcatgattggtttcagacttgttcctcctggaaacactccctaacaagcacccttgcaggaatgaagacacaccacacacatctaccccattactgcatgtactcaagagtcagcttttatatgatctctcccaagtgctcctataatggggatctttcactcaccctaaagtgaggacaaaatacttgaaagcatgagcccagtgcctgtaggtgtgcaattaacctcagaccaaggaagtgccgaacgcatctggcttttagcaaggcacctgacaaagtccttcaggatgtttttgtacatgagctagagaaatgtacctggagaacagcttctactgccagatgatcttactcaaaagatgcagattaagcaaaatatcaacccaaagggtggtccctgatggcccaccagcccctgtgcctggctcgtttcctatgtttcctagatttggtttcagacttgctcctcctgcagacactccctaaccagcatccttgcagaaaactggtgaactagaaaaggcctgtgtgggtcacgtggccacccaacaccacagcagtgtctaaggtatgcgtgggagcctgcacagcaggagcggggtcttctggagacccgcatgagatgcaaagggcagtggacaaggagccaagggaggtggctctagtcacgctggtatggtgccagcttgaggatgctgggcaagtcccgagccgtctgccttcctagtaccacagttaccactgtctgttacctcgcgagttcaagtgcttcacgtgagacagctacgagacaggcccctggaaactggaaaatgcyaagtaaatgtcatgcacaattgttgttcacattttatctcaatcacttttaccaaatcaggctaaaccctgggtattcataacgtcttgggctgtacaaattgttccttgaaatgactcagagacattttctgaattggcttccatcagccaagcatttcttcagaactggaaaaatgctttaaatttggctttgtcatgattattaaaacactctgtacattttttattattgaaattaacacattgcctactttttaaaaattggaaaaagaaaaaaaaaaaaaaaa

SEQ ID NO: 570 - DNA, 951 bp, Homo sapiens
aaaattgaatattgagataccattctttagtgttaccttttttacccacatgtgtttctgaaaatattggaattttattcatcttaaaaattggacccggccttatttaccatctttaatccattttagtactatgggtgagtacatggaattgaagtctggcttaaatcttcagaaagttatatatctattttattttatttttttgagacagagtctcgctgtgtcacccaggctggagtgcggtgccacaatcttggctcactgcaacctctgagtcccaggttcaagcgatactcatgcctcggcctcctgagtagctgggactacaggcgtgcaccaccacatctggctaatctttttttgtatttttagtagagacggggtttcactgtggtctccatctcctgacctcgtgatccgcctgcctcccaaagtgctgggattacaggcatgagccaccgcacacagctgggactgggtaatttataaagaaaagaggtttaatgactcacagttccgcatggctggagaggcctcaggaaacttacaatcatggtggaaggcgaaggggaagcaaggcacgtcttacatggtggcaggagagaacgagtgaggggggagactgccacaaactttttttttttgagacaagagtctggccctgttgcccaggctggagtgcagtggcatgatctcagctcactgcaacctctgcctcacaggttcaagcaattctcatgcctcagcctcccgcatagctgggaccacaggtatgcaccaccacacctagctaatttttgtagttttagtagagatggggtctcactatgttgctcaggctggtctaaaactcctgggctccagcaatccgcctgccttggcctcccaaagtgctggggttacaggcataagccaccacatccagcctgccacatacttttaaactat

SEQ ID NO: 571 - DNA, 819 bp, Homo sapiens
cagcttaaaaatggtttcttgaaatcagtgattagcattcactcaccagtacccctactaaggggtaggcactggtttgtactcctgggaatacaggagtacaccagaatttatttctgcttattgcttttgttgcaaatgccgtggcttcatctgaggaattctagaattcagagggtgtagccctccactctgctgtcttgctatctgctctcattgcatccgtttaacctgcattctgaaagatgtttctcaggtttttccttgacgattttcttcttttctgattctgacaatgttttaaatcattgtactgtggttatcatttctctgcatttattttacccatcttcctttgtaacttgtcctattgtcttttaatttctgcctgttctttatggctttcaacttcataaataacatgttttctcaaatctctttgtgaattccagagagggccaggcacggtggctcacatctgtaatcccagcactttggggaggctgagacgggtggatcacttgaggtcaggagtttgagaccagcctggccaacatggtgaaatcccgtttcactaaaaatacaaaaattacccaggcatggtggcgggcgcctgtaatcccaggtactcgggaggctgagggaggagaatcgcttgaacctgggaggctgagggaggagaatcgcttgaacccgggaggcagaggttgcagtgaaccgagatcatgttgctgcactccagcctggtcaacagagcaagactctgcctcaaaaacaaacaaataaacaaacaaacaaacaaaacagagagattttgct

SEQ ID NO: 572 - DNA, 203 bp, Homo sapiens
tatagaatactcaagctatgcatcaagcttggtaccgagctcggatccactatttacggccgccagtgtgctggaattcgcccttagctcggatccactagtccagtgtggtggaattccattgtgttgggcccaacacaatggagccaccacatccagcctgccacatacttttaaactatcaggtctcatgagaactcatg

SEQ ID NO: 573 - protein, 132 aa, Homo sapiens
MVEGEGEARHVLHGGRRERVRGETATNFFFLRQESGPVAQAGVQWHDLSSLQPLPHRFKQFSCLSLPHSWDHRYAPPHLANFCSFSRDGVSLCCSGWSKTPGLQQSACLGLPKCWGYRHKPPHPACHILLNY

SEQ ID NO: 574 - protein, 62 aa, Homo sapiens
MTHSSAWLERPQETYNHGGRRRGSKARLTWWQERTSEGGDCHKLFFFETRVWPCCPGWSAVA

SEQ ID NO: 575 - protein, 76 aa, Homo sapiens
MVKSRFTKNTKITQAWWRAPVIPGTREAEGGESLEPGRLREENRLNPGGRGCSEPRSCCCTPAWSTEQDSASKTNK

SEQ ID NO: 576 - protein, 68 aa, Homo sapiens
  VARIANT (1)...(68): Xaa = Any Amino Acid
MLGKSRAVCLPSTTVTTVCYLASSSASRETATRQAPGNWKMXSKCHAQLLFTFYLNHFYQIRLNPGYS

SEQ ID NO: 577 - protein, 57 aa, Homo sapiens
MYLENSFYCQMILLKRCRLSKISTQRVVPDGPPAPVPGSFPMFPRFGFRLAPPADTP

SEQ ID NO: 578 - protein, 51 aa, Homo sapiens
MQLIYLCFLGLLYIRHHDSQSFVILYYKKLNYYFKYGQIRAFHIAKVYQPH

SEQ ID NO: 579 - protein, 56 aa, Homo sapiens
MHFTFMQLIYLCFLGLLYIRHHDSQSFVILYYKKLNYYFKYGQIRAFHIAKVYQPH

SEQ ID NO: 580 - protein, 67 aa, Homo sapiens
MELRTKALRTAQQLTSCVTALKAAGPPLTFWKGKWVQCCLPLWGLLGSHAFYIYAVDIFMFPGSFIH

SEQ ID NO: 581 - protein, 77 aa, Homo sapiens [sequence omitted]

SEQ ID NO: 582 - protein, 51 aa, Homo sapiens
MLFLQTIDTKCTGIEINRNWSKVWHTHSHVDVKLCLEFLCGVWFGLGFLGV

SEQ ID NO: 583 - protein, 60 aa, Homo sapiens [sequence omitted]

SEQ ID NO: 584 - protein, 76 aa, Homo sapiens
MCLCIPLGGYQELCHCMSTSDGFAPPPQLGSRCSHIRGPIKIARNKFPRTLTSQELRRFAEYSGMMFGDQTTAGQK

SEQ ID NO: 585 - protein, 50 aa, Homo sapiens
MVYRFGQMSDNPFYILASLGSSSCRNGLASKWRQADPSDGYMEPCFQLLF

SEQ ID NO: 586 - protein, 60 aa, Homo sapiens
MLVHIYSCCGMVYRFGQMSDNPFYILASLGSSSCRNGLASKWRQADPSDGYMEPCFQLLF

SEQ ID NO: 587 - DNA, 1408 bp, Homo sapiens
ctggacactttgcgagggcttttgctggctgctgctgctgcccgtcatgctactcatcgtagcccgcccggtgaagctcgctgctttccctacctccttaagtgactgccaaacgcccaccggctggaattgctctggttatgatgacagagaaaatgatctcttcctctgtgacaccaacacctgtaaatttgatggggaatgtttaagaattggagacactgtgacttgcgtctgtcagttcaagtgcaacaatgactatgtgcctgtgtgtggctccaatggggagagctaccagaatgagtgttacctgcgacaggctgcatgcaaacagcagagtgagatacttgtggtgtcagaaggatcatgtgccacagatgcaggatcaggatctggagatggagtccatgaaggctctggagaaactagtcaaaaggagacatccacctgtgatatttgccagtttggtgcagaatgtgacgaagatgccgaggatgtctggtgtgtgtgtaatattgactgttctcaaaccaacttcaatcccctctgcgcttctgatgggaaatcttatgataatgcatgccaaatcaaagaagcatcgtgtcagaaacaggagaaaattgaagtcatgtctttgggtcgatgtcaagataacacaactacaactactaagtctgaagatgggcattatgcaagaacagattatgcagagaatgctaacaaattagaagaaagtgccagagaacaccacataccttgtccggaacattacaatggcttctgcatgcatgggaagtgtgagcattctatcaatatgcaggagccatcttgcaggtgtgatgctggttatactggacaacactgtgaaaaaaaggactacagtgttctatacgttgttcccggtcctgtacgatttcagtatgtcttaatcgcagctgtgattggaacaattcagattgctgtcatctgtgtggtggtcctctgcatcacaaggaaatgccccagaagcaacagaattcacagacagaagcaaaatacagggcactacagttcagacaatacaacaagagcgtccacgaggttaatctaaagggagcatgtttcacagtggctggactaccgagagcttggactacacaatacagtattatagacaaaagaataagacaagagatctacacatgttgccttgcatttgtggtaatctacaccaatgaaaacatgtactacagctatatttgattatgtatggatatatttgaaatagtatacattgtcttgatgttttttctgtaatgtaaataaactatttatatcacacaatawagttttttctttcccatgtatttgttatatataataaatactcagtgatgagaaaaaaaaaaaaaaaaaaaaaarwmgaccc

SEQ ID NO: 588 - protein, 81 aa, Homo sapiens [sequence omitted]

SEQ ID NO: 589 - protein, 157 aa, Homo sapiens
MTMCLCVAPMGRATRMSVTCDRLHANSRVRYLWCQKDHVPQMQDQDLEMESMKALEKLVKRRHPPVIFASLVQNVTKMPRMSGVCVILTVLKPTSIPSALLMGNLMIMHAKSKKHRVRNRRKLKSCLWVDVKITQLQLLSLKMGIMQEQIMQRMLTN

SEQ ID NO: 590 - protein, 347 aa, Homo sapiens
MLLIVARPVKLAAFPTSLSDCQTPTGWNCSGYDDRENDLFLCDTNTCKFDGECLRIGDTVTCVCQFKCNNDYVPVCGSNGESYQNECYLRQAACKQQSEILVVSEGSCATDAGSGSGDGVHEGSGETSQKETSTCDICQFGAECDEDAEDVWCVCNIDCSQTNFNPLCASDGKSYDNACQIKEASCQKQEKIEVMSLGRCQDNTTTTTKSEDGHYARTDYAENANKLEESAREHHIPCPEHYNGFCMHGKCEHSINMQEPSCRCDAGYTGQHCEKKDYSVLYVVPGPVRFQYVLIAAVIGTIQIAVICVVVLCITRKCPRSNRIHRQKQNTGHYSSDNTTRASTRLI

SEQ ID NO: 591 - DNA, 565 bp, Homo sapien
actaaagcaaatgaacaagctgacttgctagtatcatctgcattcattgaagcacaagaacttcatgccttgactcatgtaaatgcaataggattaaaaaataaatttgatatcacatggaaacagacaaaaaatattgtacaacattgcacccagtgtcagattctacacctggccactcaggaagcaagagttaatcccagaggtctatgtcctaatgtgttatggcaaatggatgtcatgcacgtaccttcatttggaaaattgtcatttgtccatgtgacagttgatacttattcacatttcatatgggcaacctgccagacaggagaaagtacttcccatgttaaaagacatttattatcttgttttcctgtcatgggagttccagaaaaagttaaaacagacaatgggccaggttactgtagtaaagcatttcaaaaattcttaaatcagtggaaaattacacatacaataggaattctctataattcccaaggacaggccataattgaaggaactaatagaacactcaaagctcaattggttaaacaaaaaaaaaaaa

SEQ ID NO: 592 - protein, 188 aa, Homo sapien
TKANEQADLLVSSAFIEAQELHALTHVNAIGLKNKFDITWKQTKNIVQHCTQCQILHLATQEARVNPRGLCPNVLWQMDVMHVPSFGKLSFVHVTVDTYSHFIWATCQTGESTSHVKRHLLSCFPVMGVPEKVKTDNGPGYCSKAFQKFLNQWKITHTIGILYNSQGQAIIEGTNRTLKAQLVKQKKK

SEQ ID NO: 593 - DNA, 271 bp, Homo sapien
  misc_feature (1)...(271): n = A,T,C or G
actttatgttcnagtgcanaaanccncctggattgccaccntactctcagggctgtganttgtgcncccanagcaacctgggcacgcggggacaggggggccnacaattgagggagcggtgtccctagctggggtctatacatgncngggnaagggcngctgagtnccatnagcaaagganctagnatntgcgggggtgcggcctgggcctaccctttnaagcatccntngatccactccangaanccnggggtagncaggtttnccaaca

SEQ ID NO: 594 - DNA, 376 bp, Homo sapien
  misc_feature (1)...(376): n = A,T,C or G
cctttgggggnggggggaacctttaccattgtncccctttatttcatttggttngggttcgcgccctcnngggccaacaaagttatcgtnnttgaagagaanatttttttggnttngncccgattaagcgncaaatgtgtagcaaaangccgtgccacttgtggcgtagctncgtcgggtcgattcgacgacaaggcgtngcgcgntancgttagtctcnaatngacccngtggcatgagcccacganggnttcgtgtcgtcacatggnctctagacataacgcncnccnttttttncagagggggntgccgcccttagggaggnaggggtggggacactagccaanccanantctnaccccattgaagaaaaggn

SEQ ID NO: 595 - DNA, 242 bp, Homo sapien
  misc_feature (1)...(242): n = A,T,C or G
agnctgctgntcgtnccctntatgtggcttcatnntgaggacaanagtngcactgaggcttgngnatgccaggcaaggncaagctggctcaaaaagcatccacccacctctgnaangggtatgccangagcangtgcaccagtcccaactangagncccnggcatgntacatcttcttccacccctnaaantttgngctacaangnccatttttctttttctcttaagggncncntggcttc

SEQ ID NO: 596 - DNA, 535 bp, Homo sapien
  misc_feature (1)...(535): n = A,T,C or G
accagttggatactgctaaanagatatttatgcagcctcatatgttaagtcgtatattttgaaagctttttaaattttttctttaagaagattttagatgcttatcactgagtaccagagggatgtaggctgatgcccttatcaacaaagtcagggactgtggcacacaaggattgactactgcagacacggccacaatgctacctctagagggcctgaatccccctgccctctctggtggggagaagggctggcagagccattagcatgggctccggccaatcctggccactttgacactcctggtgctgacccagggtcctggaggaagggatgaggtgggcagtagagatgctcagggcagtggcccctttccatccacactggaactatttcagtattttaccaccaattcagccattcccttgtgcgctggctgaacatcagccctgctccaggtctcagtttcccctttgtaaagggaaagctctggattcagggagtgatgaagaggtcatcatggtcttgagaattc

SEQ ID NO: 597 - DNA, 257 bp, Homo sapien
  misc_feature (1)...(257): n = A,T,C or G
tttcnatacccaaaantaccccatattangaccanacatttgtctnggaaaaattaccattntntaacntttgggccacctgagannaaatgggtgtaatncatgataagatggancagnattnctcttaagatnngatnagaccccgtttttcacggaacatatccaagnacccaataggnaacaagccacgggnggagtcacaaacatatattctttactctcataatccgtnncacanaactnttgnacttgac

SEQ ID NO: 598 - DNA, 222 bp, Homo sapien
  misc_feature (1)...(222): n = A,T,C or G
nntggntaccgtcnaaacttnncttggtacccgagctcggatccactagtccagtgtggtggaattccattgtgttgggctataagctgtaatagtggagncgtgctnggttcattgcannagnccctccgcanncacncttgnnacaacctgtgagnaggcnataaattattcacataatcatcactgcatgaanctgactcaaacgcatccacntacacc

SEQ ID NO: 599 - DNA, 238 bp, Homo sapien
  misc_feature (1)...(238): n = A,T,C or G
gcatgacatcancgatgtntttggnnacctganattngctaaaactngngnatgccgggnatgnaggtttggtantgatctatgcactcacatctcatggggacgtttcatgtggagtgntcgacaangttgctgnancngagaagtgatgatctcagttgaaagggtcatgtgaatacacnttacacttgaaaaagaagcacattgggaatatcacgaaacgnccaccaacatcctg

SEQ ID NO: 600 - DNA, 232 bp, Homo sapien
  misc_feature (1)...(232): n = A,T,C or G
cgaactatttagactacctaggaaaattattttagtatcagaagaatatcaggggtgtagtactcatcagagctaaatgagagcgctttaaaaatgttagtttgtcttccgccatttctacagaaagctgcaatttcaggttttcaacctaataggtgatatttaanaaaaaaaaaaagcaatcgcaaatagccccactgcttttacaaatcattttttccccaacacaatg

SEQ ID NO: 601 - DNA, 547 bp, Homo sapien
  misc_feature (1)...(547): n = A,T,C or G
cattgtgttggggaaaaaatgatttgtataagcagtggggctatttgcgattgctttttttttttcttaaatatcacctattaggttgaaaacctgaaattgcagctttctgtagaaatggcggaagacaaactaacatttttaaagcgctctcatttagctctgatgagtactacacccctnatattcttctgatactaaaataattttcctagtgtagtctaaacttttttaaaaagacatgtaatccgcggagttagtaactcaaaacgagtgcatctnggaagtatcgcagccgttnctggatnaaattcccagcttgctngcttgctnagccggggggcggtnaaaaaaacatctgcagcccnggggnaaaaaccttcgcattgttcttacgtgtttacgttattttatttccctnnagcaaggcnggganttggggactcgaaatggtacagttgggctggggatcgcccttgttacataaaagncgtccagaagagggacggttacaggcnggganctccaaaggtcagtccctgccatt

SEQ ID NO: 602 - DNA, 826 bp, Homo sapien
  misc_feature (1)...(826): n = A,T,C or G
cggggggnnttacgtctctctggacgcttttattgtaccagggcgatcccagcccaactgtaccattcgagtccctactcctgccttgctctagggaaataaaataacgtaaacacgtaagaacaatgcgaaagcgttttcttccctaggctgcagattgtcttcttcaccgcccctgcttagctagctagctagctgggaatttaatccagaaacggcttgcgatacctcctagatgcactcgttttgagttacaaactccgcggattacatgtctttttaaaaaagtttagactacactagggaaaattattttagtatcagaagaatatcagggggtgtagtactcatcagagctnaatgagagcgctttaaaaatgttagtttgtcttccgccatttctacagaaagctgcaatttcaggttttcancctaataggtgatatntaagaaaaaaaaaacaatcgcanatagcccactgcttttacaaatcatttttctcttctaggtatagcctgtcaggtggcctaatgtatttttgacatctctaggaattttaatagaccagaaatgggtgccagagatatgcctgcactaatcttaagtggggatttatgtatttctcaancaagtgattaaagcaaaactaggcacgaatgaaatcaagatctttaggccagaaatcatgaananttttanaattattttangaatctgtggcttctcttcttaaaatngaaaaaaaaattgtttaaacccanaaggtctgaatacccaagcnccctgaacnanagaacaangccggagcaccccctcccaaatcccc

SEQ ID NO: 603 - DNA, 817 bp, Homo sapien
  misc_feature (1)...(817): n = A,T,C or G
nnangacttttgtggtnttatacaattnttttttctatttctatgaagagaaagccacagagtcctaaaataattctaaaactcatcatgactttcttgcctaaaagatcttgatttcaatcgtgcctagttttgctttaatcacttgcttgagaaatacataaatccccacttaagattagtgcaggcatatctctggcacccatttctggttctattaaaattcctagagatgtcaaaaattacattaggccacctgacaggctatacctagaagagaaaaaatgatttgtaaaagcagtggggctatttgcgattgctttttttttttcttaaatatcacctattaggttgaaaacctgaaattgcagctttctgtagaaatggcggaagacaaactaacatttttaaagcgctctcatttagctctgatgagtactacacccctgatattcttctgatactaaaataattttcctagtgtagtctaaacttttttaaaaagacatgtaatccgcggagtttgtaactcaaaacgagtgcatctaggaggtatcgcaagccgtttctggattaaattcccagctagcttgcttgcttagcaggggcgggnaaanaagacatctgcagcctagggaagaaaacctttcgcattgttcttacgtgtttacgttattttatttcctanaacaaggcngaattgggactcgaatggttcagttggggtgggggatcccctggtncataaaangtcanaaaganggtacaggcggaacnccaagggtcgtcctgcatttanactcggaattttggtgcc

SEQ ID NO: 604 - DNA, 694 bp, Homo sapien
  misc_feature (1)...(694): n = A,T,C or G
cttttcaaatcatttttnctcttctaggtatancctgtcaggtggcctaatgtaatttttgacatctctangaattttaatagaaccagaaatgggtgccagagatatgcctgcactaatcttaagtggggatttatgtatttctcaagcaagtgattaaagcaaaactaggcacgattgaaatcaagatcttttaggcaanaaagtcatgatgagttttagaattattttaggactctgtggctttctcttcatagaaatagaaaaaaaaattgtataaaaccacaaaaggtcctgaatagccaaagcaacactgancaaaaagaacanagcagggaagcaacacactaccngaattcaaattatactaccagggtgtagtaaccaaaacagcattctattggcataaaatagacaccaagaccaatggancagaataaagaaccccacaaataaatccatatatntaccgccanctgattatcaataacnaacaccaagaacatatnttaagggacntnctattcaataantagtgctggnaaaaactgggaaatccatatgcagaaanaatgaaactagacccctatccctcaccatacgcaaanntcaacttcggaatgggattacaaaacttaagacattccaacccaagaaactatnaaanctactattaagaaaacagatcncnccc

SEQ ID NO: 605 - DNA, 678 bp, Homo sapien
  misc_feature (1)...(678): n = A,T,C or G
taaaaatctagactacactaggaaattattttantatcagaagaatatcaggggtgtagtactcatcanagctaaatgagagcgctttaaaaatgttagtttgtcttccgccatttctacagaaagctgcaatttcaggttttcaacctaataggtgatatttaagaaaaaaaaaaagcaatcgcaaatagccccactgcttttacaaatcattttttctcttctaggtatagcctgtcaggtggcctaatgtaatttttgacatctctaggaattttaatagaaccagaaatgggtgccagagatatgcctgcactaatcttaagtggggatttatgtatttctcaagcaagtgattaaagcaaaactaggcacgattgaaatcaanatcttttaggcaagaaagtcatgatgagttttanaattattttaggactctgtggctttctcttcatagaaatagaaaaaaaaaattgtataaaaaccacaaaaggtcctgaatagcccaaagcaacactgaacaaaangaacaaagcaggaagcaacacactaccggaattcaattatactaccaaggtgtantaaccaaaacagcattctattgggcataaaatagaccaaagaccagtgggaaacagaataaagaancccaaaataaatcctatatttacngcccnc

SEQ ID NO: 606 - DNA, 263 bp, Homo sapien
  misc_feature (1)...(263): n = A,T,C or G
gtggggtcngcancagccaactcagcttcctttcgggctttgttagcagacggatcatcctctagtccactgtgntcaaattccattgtgtgggggccnctcgcctcggccanagatctgagtgancanacntgtccccactgaggtgccccacagcngnttgtnttcagcangggctnacaactcgaccggcagcgnanggctggcagaantgngcgcctnnctcattcctacgcngtnngccgcaggaaggangacaggcc

SEQ ID NO: 607 - DNA, 22 bp, Artificial Sequence
  Primer
ccatgtgggtcccggttgtctt

SEQ ID NO: 608 - DNA, 22 bp, Artificial Sequence
  Primer
gataggggtgctcaggggttgg

SEQ ID NO: 609 - DNA, 40 bp, Artificial Sequence
  Primer
gctggacagggggcaaaagctggggcagtgaaccatgtgc

SEQ ID NO: 610 - DNA, 27 bp, Artificial Sequence
  Primer
ccttgtccagatagcccagtagctgac

SEQ ID NO: 611 - DNA, 46 bp, Artificial Sequence
  Primer
gatagagaaaaccgtccaggccagtattgtgggaggctgggagtgc

SEQ ID NO: 612 - DNA, 40 bp, Artificial Sequence
  Primer
gcacatggttcactgccccagcttttgccccctgtccagc

SEQ ID NO: 613 - DNA, 38 bp, Artificial Sequence
  Primer
gccgctcgagttagaattcggggttggccacgatggtg

SEQ ID NO: 614 - DNA, 53 bp, Artificial Sequence
  Primer
cggcgggcatatgcatcaccatcaccatcacatcataaacggcgaggactgca

SEQ ID NO: 615 - DNA, 46 bp, Artificial Sequence
  Primer
gcactcccagcctcccacaatactggcctggacggttttctctatc

SEQ ID NO: 616 - DNA, 1350 bp, Homo sapien
atgcatcaccatcaccatcacatcataaacggcgaggactgcagcccgcactcgcagccctggcaggcggcactggtcatggaaaacgaattgttctgctcgggcgtcctggtgcatccgcagtgggtgctgtcagccgcacactgtttccagaactcctacaccatcgggctgggcctgcacagtcttgaggccgaccaagagccagggagccagatggtggaggccagcctctccgtacggcacccagagtacaacagacccttgctcgctaacgacctcatgctcatcaagttggacgaatccgtgtccgagtctgacaccatccggagcatcagcattgcttcgcagtgccctaccgcggggaactcttgcctcgtttctggctggggtctgctggcgaacggcagaatgcctaccgtgctgcagtgcgtgaacgtgtcggtggtgtctgaggaggtctgcagtaagctctatgacccgctgtaccaccccagcatgttctgcgccggcggagggcaagaccagaaggactcctgcaacggtgactctggggggcccctgatctgcaacgggtacttgcagggccttgtgtctttcggaaaagccccgtgtggccaagttggcgtgccaggtgtctacaccaacctctgcaaattcactgagtggatagagaaaaccgtccaggccagtattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagctggggcagtgaaccatgtgccctgcccgaaaggccttccctgtacaccaaggtggtgcattaccggaagtggatcaaggacaccatcgtggccaaccccgaattctaa

SEQ ID NO: 617 - protein, 449 aa, Homo sapien [sequence omitted]

SEQ ID NO: 618 - DNA, 385 bp, Homo sapien
  misc_feature (1)...(385): n = A,T,C or G
ctgtgctgagaaccaaaagctatgancactgcttttccaaatgtccataanaccaacatttttatcactaccaccatcacctgggagctcnttagaaagctagtctcccgggcaccaccctggcctactgaacctaatgtgcatttaacaagattnacgtngaaatctgcaaagcacaggggcngataacagtaccacctgntctggttcctanccccangacccttacagtctaactgggacacaagggcttnaaatcaaattgcctatcattaagatatacaangancntgagaaactgctncacttatntattaaggngctctaagacttagaaacnaaangcantgctgagangattcaaatatgangggggncactttnc

SEQ ID NO: 619 - DNA, 869 bp, Homo sapien
  misc_feature (1)...(869): n = A,T,C or G
gatatcccgggaattcgcggccgcgtcgacctctacttgtttagacataaatgcagtctagcattaaagatcctttaaaaaaatgttttcccaatggttaaaagacaagctcaaataaatgaactctcatacatatgccaaaattgatgagtagataaatatttcagtaggtagttactagctttctgtgtatgagtaaacatatgggagaaatttaaaacactaaagtagactcaatgaaagcatagtatcctatgtattcgtttttcagaaatgtctaatgaaggaaggaaacaatgaatgaatgcccttattcctcttagagtgctgggacatggttttgcctgaaaacttcatgtgaattttatattttgctacacattacacccatcttagacttatacgtataagacataaggcatatcttatgtcttacatgtataataatctaagcagaacaaaaaataacgaaatattttcttccccaaatttttgagacagatggattttccggaaagatgtgtttagcttttaatcctgtggttttgtgtaccacctggcacactagagtgttgctctaattcagtgagttgtaactctgggtgaacagtggaaatactagggtacattttaaaaatgctaatgctcgggcctcgctgaagaccaaattaattggaatctctgngggnggnattgatctttttataatctttctanangattctaatgggcttccagggatgaaaaccnctgntggagctnggaaccttcctttagtttggagaaaccccgatgagggtntnttaggcnccgcctntttttggcctgggcttccccccttatnntnttttggaanggnccnaattttt

SEQ ID NO: 620 - DNA, 339 bp, Homo sapien
  misc_feature (1)...(339): n = A,T,C or G
gngcgggcctcnccgtgcttgctctcgctgccgacgctctttttccaccagctgtagganaagcccgaagaccactggtcccccgggtagcccaagtaccactggtcctcctggctcctgacgctncgggtcttcctcgtggcgtagactgccagcttcggagacccctcagcccctccccgcttttctccaccccaggaggccatcagtagcgagctactgcctcggccacaacctcccagcangatagcccgcggtttccaatctgcgaaaggaggaccgccnagcccgaaatgccnagcccagcnatcactgccacgccgagccnagcgctcgtgc

SEQ ID NO: 621 - DNA, 267 bp, Homo sapien
  misc_feature (1)...(267): n = A,T,C or G
ggggngcatggtcccnggtagccaagtacatggtcctcctggctcctgacgctacgggtcttcctcgtggcgtagactgccagcttcggagacccctcagcccctccccgcttttctccaccccaggaggccatcagtagcgagctactgcctcggccacaacctcccagcaggatngcccgcggtttccaatctgcgaaaggaggaccgccnagccagaaatgccnagccnagcgatcactgccacgccnagccnagcgctcgtgc

SEQ ID NO: 622 - DNA, 847 bp, Homo sapien
  misc_feature (1)...(847): n = A,T,C or G
cttangntgtcgactgacgtcatgcatganttaaagcagaggtttggtgaaatttatgaaaaatacaaaattccggcttgtcctgaggaagagccactacttgataactctacaagaggaacagatgtgaaggatattccctttaatttgacaaataacatacctggttgtgaggaagaagatgcatctgaaatatctgtctcagtggtattcgagacatttcctgaacaaaaagaacccagtctcaaaaatatcatccatccatactatcatccgtactctgggtcccaggaacatgtttgccagtcatcttctaagcttcatttacatgaaaataaattagactgcgacaatgataacaaactaggcattggacatatttttagtacagataacaactttcataatgatgcaagcactaagaaagcaaggaacccagaagtggttacggttgaaatgaaagaagaccaagagtttgatttgcaaatgacaaaaaatatgaaccaaaatagtgacagtggcagtacaaataactataaaagcctgaaacctaaattagaaaatctgagttctttaccaccagattctgacagaacatcaggaagtatatctacatgaagaattacagcaagacatgccaaaagtttaagaatgangtcaacacattagaaanaaganttctgggctttgaagaaagaaaatgttccacttcataaagaaggttgaaagaagaatgggagagcccngaantttttgcccngaaattttcgggaaccctactggatgggtcnactggttggccatgaatgaataatggactaatcnnccaattcctngggaagggaat

SEQ ID NO: 623 - DNA, 681 bp, Homo sapien
  misc_feature (1)...(681): n = A,T,C or G
aaaactgtactcgcgcgctgcatgtcgacactagtggatccaaagaatcggcacgagcgaaaangctcangcagcccggctggccgccgccgctcctccccccaggaaagccaangtggangctgatgtggctgcangagctcgtttcacagcccctcangtgganctggttgggccgcggctgccangggcggaagtgggtgtccccangtctcagccccaaggctgcccctcacaaagcactggtggtttgcctccactgccaccttgggctccgaacccgctcccctgctgtggangcccaccgtgggaatccaggtccccaggtggactgcctgccttgccctcactgcccactctgcccacacttccctgcctaganaccgggaaggggctgtgtcggtantggtgcccacctggatgtggcagcaccgactgtgggggtggacctggccttgccgggtgcaaaagtgggggcccngggaaaagcacctgaagtggccctgaaaaatccccccttaattttnccccaatttggggctcnaacaaaaggaaattgctgaagccaanggtaccaaggtcacccctaaggccagggtgaaaaggtcccaaaattccaatncccaccntttgggcttncctcttggaaccccggccccctctcntgaanttttaaaaaan

SEQ ID NO: 624 - DNA, 661 bp, Homo sapien
  misc_feature (1)...(661): n = A,T,C or G
attggtcttactgtaccaccgggtggaaatcgatggccgcggcgtctaaatatccgattttttttttttttcctcttctgactgtccatggacaaatgaaactaacttaatctaactaaaaaacacaactatattttgaagattttctatctgcactcaaggacactttccacncggttgttgttaccttttggtcttgtctctgaacatgaaattnatctcaagggattngatttctggacctcctattcctgctatgggtttgatatttcttgggctccagggccactgttgcattgggntgacagntacctcctagcccatancctcctatcttgggaaacaaacctaacaactacgtgtaccttccatagatctctgattgagtctcagtatncgcttgctcatgggcgattcacttgaatccgtnattggtgccaacaatcctgactcatgggnnaatggatcctatcacgttcccctgattngcaacccctgtatacatanatctaatcgcatagaatctagcntnggntatgcgcggctacgctatcagggnttgntaactatngcatggctacgaancctgatcatgatcnagggtcatggactcttatcaggggggttgggccgngcttctttttcnnaccttggtaaaacc

SEQ ID NO: 625 - DNA, 181 bp, Homo sapien
gcaacaatcagatcatgttaaagtaaatctccattgccctggatcacttcaggatttaattgtccaaggagagcagggttctcctgtgaaaaaaaggtggggaaatgtttgagagtaaaaaatacaaaattcaaccggtcgaaaatacaccactccattcagtgctctacccccataagcc

SEQ ID NO: 626 - DNA, 181 bp, Homo sapien; identical to SEQ ID NO: 625

SEQ ID NO: 627 - DNA, 813 bp, Homo sapien
  misc_feature (1)...(813): n = A,T,C or G
accaagctggagctcgcgcgcctgcaggtcgacactagtggatccaaagtgaacgtgaaggtgagcagaggagaacttgcgatggcaaagttaaaaacaagaggagatgatggtcttggtgtggcacaggatgttaaaaaaattctcctgtccttaaggagttactgctatttgagtaatgtgccacttccctacatagccttctatgcagaaatgctatatttccacttcacaacccagaacgtgcattttattttacatttagaggaggaacaaacaaccagaaggcaaaaactggtgcattattttttgcaattctcttggaaagagttcgtttttaacttctgctcagacagcacacaactactgggaatatattttaatttcaaatctgatgtgtgacatctggtaactcatttattgctaatgaagttttcacaggaagcagcagtcaccagtagctcatcttatttttcagttggcaaagtgttgtttaccttttattggcctgcatcggtgtctcttatcacaggatatttaattagaaaacgcaagtagcctaacatagaanagaaatggagtggtagataatagtagatagaatggctaaatatttttattacagtgatgtaatatcactgnaatttatggttaaaaattatgtaatactcaaaaggaattctcagactggcgaaacagctggncaacagctntcacagggctttnanctcctnttgagctttccccctgntggactttagtcttccttttacncccgnagttnccattnnttaccaattgtnccgggaaana

SEQ ID NO: 628 - DNA, 646 bp, Homo sapien
  misc_feature (1)...(646): n = A,T,C or G
tttgggnggnggtgtctcntttgggtggactttttgggtcgtagggccccaaggccgttaatcccgtaataacggaagacgaagaagagtcagaagagtgcttctataaggatcgggacgagactaccttagaggaataaaggaaaaaagcagaggaggaagagtggtagaaggagtcagaagaaacccacacgtcgttctgaacctggagccttatcaaaaaggtctagataaacgatagcgatctcgatatcgagctcaagaggtaggtttagagacttctcgtcctcgagagcgaaatggaagatctcgacgacgataagaagttaaagtgtagagggtgcttgaggagcgcgtggaaggattctgcggagggacccatcgacgtagagacttgaaggcctactaaggtccacaagaagcccggctctttctccgaatggtcggagcgtacagtatgcgacgtcgatcggcagacaagctggcggtagactcgaagtgttcgggcgaatcgacttataatagtcgcgcgctagtaacgtaggaacacgaagagtagtcgaaagaaaacgtttagtgagggaaaagattagggaaaaaggagaggcttaataactaagacacttggagcctaggccaacgcgaa

SEQ ID NO: 629 - DNA, 617 bp, Homo sapien
  misc_feature (1)...(617): n = A,T,C or G
gcccccncccccctcctngggcttatngggacagacccacgtagtactctaaatcttctcctacgccggacaacggaccctataccaattcgaatcttggacactccgaccgccggattctcttcccctttcggcttcccctttctgtcggtacccctccctagtcgtctcctacaccttcgtaccgtcgatatatagtcgccgcggactagcctatttaggtgtcctagactcgttattgatccactcattagtctagtactatgcgtcacgtatcttagttgcctaagagggagattaaatcctccacaagttccgacgaattcctggactctcgtactagcaaactttcttatgaggcttccttgtatatcttctggatgtttctcgtgtcccggtcctccgctactactagagctccttgccctatctctagaagtagaggactctcgggttcgttctccaaatctagcgctagagctatcgctacccgctcgattcccccagcggaatcttgaaacctgaggtagtacacaaaccctccncatcttccctcggttgctccttcttctcatccccccttcccgccttctcgggaangaatctactttancttc

SEQ ID NO: 630 - DNA, 644 bp, Homo sapien
  misc_feature (1)...(644): n = A,T,C or G
cnntcggcntgggttttnttctgagnnncccccccccccccccccccaaacttacacccaccaaacactttccgccccctacctaggagacattagaagggtttaggcttcggcgtatagtaaagtcctctacctcggaagtagagaattcggtatttaaattcagggttagaggctcgctcgttagatttatagtttaggtttagaatcggaaaccttcgatcttccttagaagggtaataagtgaggccctaaatccgtctaaccaaggcgttaaggtccgtacctaaacctagtcttatcttctatcaggcgcaccaatataggtaggttctactttcgtataggccttaaggaatagttcggtagttatcgaaggcactcctctctaggctaggcttttctcagtcttagtactccgggaccgtcgtcgcanaaatatcgatggacggtaggtatctccgcgttacgcgtcgggctagggatatagagcgaattatcggcgagaggcggtcgctangaatcggtatcaatatgntgttctttaccctacggatatcggcagaaaacataaaaccttctnaccanggataagggattatcggacccctaaaataacagtaacatttagantactagtaccc

SEQ ID NO: 631 - DNA, 526 bp, Homo sapien
  misc_feature (1)...(526): n = A,T,C or G
ccntcggcttgggtttttttctgagccccccccccccccccccccccccccccccccggccccatagccccaccggncccacccaaattttaacaaaataaatntacctatcgntcacctatcccncgtatcgngtaggtcggtaccggtaccggngatcncnacgattnttcgggtcgtcncccttaanacggncccgtagccnccggaanaaatactacgagngactctaatntagcaanacccgccgtcnattantagcatccttagtcttccaatgncgnggattnngaatccttnnaagttatcgggtagaacgggtcccggtcccccgccctctttncaattaacgccgggtacaaantcggtttctaaattccncacgaatttngncggcaacattcncgggnccttattanccntttccaaccccgatacncnagctcgatcgggctttancgaatccggggtcncccccgangantccgggtcctttgagtngctctaggacggttacgacggagga

SEQ ID NO: 632 - DNA, 647 bp, Homo sapien
  misc_feature (1)...(647): n = A,T,C or G
tttgggnggcgggngctcatttgggtggactttttgggtcgtaggaacctggtatgaggggtgttttgagtttcttcttcgtcgtctctgggaggttcggtttcgattgagattcgggttcgtctttatcttacgaggcaccctgatattgttgcgctttggtttggttgtggagagttttgtcctactctagcgggtcatgcggatgatatgtagcctgcgtggcctgatagtgatgttgtgagcttgagaggggagttgtgggtgttgcgggcggagtaggaggggttggagcaccgggattgggagatatagaatcataagtgttaggtataggtcgattgagcgagttcgtggaattcgtgtggtcatcataattagagtgaggatgggctctatatttcttagaggacgcacggtcgtgattcggggtttgatgggtgttcttcttgtgggcacgattagcttgttcatgatggtaaggaccatactgtttcgaatgaggattcgtgtcttcggattgttgtggatattgtggnctanactatttagtgtaagccggaggtggtttgccgtggtggagtatccgannttcattcgganggtatgcgtgcggagcggtccttgtagacattccggaaaaatgg

SEQ ID NO: 633 - DNA, 630 bp, Homo sapien
  misc_feature (1)...(630): n = A,T,C or G
tccttcggcttgggtttttttctgacccccccccccccccccccctcggaaggcctctaggctcccacccgtctctctaatcctcaggaaccgatccacccaaccaacttactaatgtcctacagtaaacacccgagaatataaacccacacctaggcctccaatcctaccagggaagcaagaagccgtagtctagcgtattacgaacccgagatagagacggagatacttagttttattctctcggaataggaaagacgactggggagggaatataggctagcgcggggataggggctatggcggatatgggggcgggtcgctctcttattcttctataccacgtcaataggaatgtagatatacctagatgttcccgtagaaagagacgttagaggtctccgaagctataaaggagaggcgcgaagaaacttcgtactctagctttatataggtagtcgctctagtcccataagcgacgagagatctactagatttcggtatcgccgtcgtatgtattcgaaatagtcttcttccccttttcgatctcctctctatactacatggngattatagtcntaagatagtcaggatattaggatattagttatatgacgttcgacgggacgg

SEQ ID NO: 634 - DNA, 647 bp, Homo sapien
  misc_feature (1)...(647): n = A,T,C or G
ccntcggcttgggtttttttctgacccccccccccccccccctccactaagancttaacccaaccctatagtttactcgtataggggaatcgaggagaaataggaacgaagagcgggtgataaagagaaagtactttcctttatatgttaagagcttagcgtaatgactttcgttatatggctagttgattttatccggcgttatagggcttagttctggttatctcgggtctaattcccttagtatgctcgggagtttaacgaggtcacgggatagcgcgtaccctttctaaggttcttggaaagctattcgttatttatcgcgattctcgaggtcgaaaggatcaaggatcttcccttttactaccctagtcgggttagcggtcggtcaaaactagtgtagtacctttacctcctcgaaagttatagtcgaaacaacgtattagtcgaaattatagcggatagatcgagacggttctttctcgggttctcagccggtaatccctctatttgggggtcttctccctcttcccctttgtcttccgccttagcttccaaggttcctcggaagcgaggggttctacttaagtcgntagcgttccttataaaccncctacaggcagacccccttgtaaacggctcggggt

SEQ ID NO: 635 - DNA, 645 bp, Homo sapien
  misc_feature (1)...(645): n = A,T,C or G
ccttcggcttgggtttttttctgagccccccccccccccccccgaaactcgccttaccctagatacccaaagaatagttccactcaacttcgtctaagtaaaactctagaacttccaaacataaaagacttcgcgcggttagctacacagcctacgggaatctcacgaatcccgattcaagtcccactctcgaccacaccccggtatcgtcgttttcccataccaatgtcgaaaaataaaataaaatccagtcaagccccacggtaagcgggggtagggctaggcgaagaggcaggaaccgttcgaggccgggggctttcaaaatacaaaacaactacttaaagtttaccccttctaaagtcgggggcaacggttaaagcacgcctctaaagtactactcgtttcgagaaggggtagtcatctcccgcatagagactctcgcgtatatcaactcgcatcgcttctagcattccgacggtcgcccgcggctacatatcttgcggattagctccgagggactatagggttaattagtctagtaaattctcttagaggatagtcggggtcgtagttaggcagtacgaggggacatggnctgcgtcgtgctctaccttgacagcatactcttataaacatctttttcct

SEQ ID NO: 636 - DNA, 643 bp, Homo sapien
  misc_feature (1)...(643): n = A,T,C or G
ccttcggcttgggtttttttctgacccccccccccccccccctagcggaaaacaatccccaccgagattttattaatcgtaaaactcgccttcggtaccaagtcttcctccttcccgtaacctggctccctcctagnggctttacgaacgtccctcctcttcttacggctcggaagtggttacggttaaatccggaggnggggctaacgaatccaaggctaactcctcttanagtttgttgtccncncgtttagtaaggatccgtggagggcgagtatttgncccccggcctttattntatagttccctagtacgataaagntaccggctatcctattacagcggataaaagttatttanagggccgacgtcnccgctagacaggctacagctagnggaggtaccgcctccgactantccgttgnttccgacaaggnagtttcggttaactccacaaactcctccgccgactctanggtggggacggcagttcccncgtttagtgtgcgttatagagaagggcatttgagttggacgttacnttttaacataggttattccgtttaggttcttgcgggcccgtgggggtagtncnccggcgcgttnntatcggcgattttccgcagtttccgtttccggntnt

SEQ ID NO: 637 - DNA, 631 bp, Homo sapien
  misc_feature (1)...(631): n = A,T,C or G
gggttntctcatttgggtggactttttgggtcgtaggaaccggtatgnaggagtaggagtcgctgggaagactagaagttagctacggacgattagtgtgattccactcttaataacgagtaatcgtttacgtcgggttggtgtttcggggttttggagagtaagcgtagttgtggagtttcgcatataggtccccttacttcggcgatctcgtcttctgtcggttaggttattattgttcatccttcgcattagtagtagggttggtcggataaatcgatagctattctttagaattcgtagtcggagaattcgtgtacgaagtcctttaagttctttaagttcgcgagtaagacgtgtacggttattttgtcgtcgacgtaggtgtcgtttacgggagtttcgttttaggggtttacgtagaacgttattaagcacggtaatacgatagaggattacgcgacgtattcgtcttagaacgtcgatttttcgaaggcgcatttgttatcgaaggggagtccttggagaatcgagatattccaagaatattacggagattacagatcggaaggctcccgagatcggacgtattaccggtctcgcccgaaacgagtaggtatcntccggataa

SEQ ID NO: 638 - DNA, 606 bp, Homo sapien
  misc_feature (1)...(606): n = A,T,C or G
ccccccccccctcaaccatcnattccccacctcaacgcgaattacggtttcgaaagtcgacaataagtccggtcgagtagagggaatcaggggctggtanaaaggaccacgggcggaaaataccggtctccttccggggagcgacgtcggggaaagggaagagagcggtctagttcgtaggcaaacaggtcagaaaagttaaggttaaaggtcggaggggagaggatagctagtacgcttagttcggggctcgggcgcagggccactttcctctttcgcgttcctttactctgcttacgagttcaggctccggagttccgcgccggaggtcgtcgcgacgctaggaatggggactcgctcagtccccggttatccttcgggattctatgttttcgccgatagacggagaccgggtagtagggttccgtcgtaccgccactcgtcgccttgatccggcccgctccgcttaagggcgatgaaagattaggtattagggctctacgggacgaggcatagggcgggagaaggggggaggggtcgggggtcgaagggantaagaaatcgcantcgcgcggggtcggtagganccgaaatttttctcnncgt

SEQ ID NO: 639 - DNA, 592 bp, Homo sapien
  misc_feature (1)...(592): n = A,T,C or G
tccntcggcttgggtttttttctgagcccccccccccccccccccgggaacgagaaaacaatcccaccctaccgcggggagtgggttgnacgcttagttctagaatcctcggaatcgtcctccggcgttggtagttccggcgattccgagtatgccgaagtgtatcgctccgtctagaggttggtatctgtttatcgcgatgacgctattgactcggatgctttcgaagtagggggataggcgcatagatacgcctccgcggtgtcctctgaagtggccgcatccgtggacgcagcgtagacagctctggtggacgataacggcttctcgtactcctactccggctattatgttagagaggacttgtttctgaacggatataccattagcgaaggggtaccctccgctaacgcaggcgtttctaacagttcttccgggcgctccgaatttagattgacgcctccgcagcattgtgggatcctcttccgttagccctctttataggatttctcctccgccccgaaaganggctggtcgtccccggcangtatgtctagctcgaacgctttgttactcctttgttttcgaaana

SEQ ID NO: 640 - DNA, 637 bp, Homo sapien
  misc_feature (1)...(637): n = A,T,C or G
ctttgtggcggtggntgtctcatttgggtggactttttgggtcgtaggcttatccgggtngggctcccgaagtagcttaggatcgccggctagttccggtcccgcccgtcgaaagcgcggttcggcgggcggccccgcgttcgttcgcgggctttaccctcatagagtgccaggtctcggttcttacgggttcgtcggcgatagattttacggcgagaggtcggtatcttcgccgctttacgttcggtcggcatctacgcctagttcacaggtagtttatgcgccggagcgcgtgacggagaggttatacgggacgcggaagaaccgcctccaaatgactagtacaggctcgttcgggcgtagatctcctcgctcggtcggcggttcttacttctagggccgctctacggtttaaggcggtcgttagatcttagaaactatactcaagtttcagtcggaagaaaggaagtagagagaagggtaaacgattacctccggttctagccctttttactcgcataacgggagaacggggtccggctctcagatacgcctcgcgagacgtcgcgattcaactttaacctccgctagggcatccgtatacggttaacgcggtaaaagcgacctcggaaacctc

SEQ ID NO: 641 - DNA, 649 bp, Homo sapien
  misc_feature (1)...(649): n = A,T,C or G
ctntgtggcggtggttgtctcagtttgggtggatttttgggtcgtaggnaacctggtatgaggtctagtttcttcaacgattcttggttcagttacgcgaccctatccttatcttacaatgtcttctacatcaggttcatcaattaatatatcaattacacattaacgacggtgtgacgcaatatgagaaagtatacattaaggttattatatattattcgcttaaaaaggttcctgacatgggacaacttcacccaccattctagaagccccccctcctgtaggaccccctcgagttccccattatcttagttcagttttcattttttaaccaggagggtatcggtttttaataggtactattttgtcaaacttttcagaagctttatcttcaaatatacttgcaccatctgtactaggagcactaactattcgagtctattacagctcaacagaaaataattgaaattaaacaacctaagtatcgtccaccataaccccatcgggctctcaccccatttcttcataagttctagagcatcctgagctctttcctattacccttgatggtactcatggtctaataccccccgcagttataggtccttatggatcctatgctaccaccggtctaatcccttctatcacn

SEQ ID NO: 642 - DNA, 645 bp, Homo sapien
  misc_feature (1)...(645): n = A,T,C or G
tccttcggcttgggttttttttcgtcgcgggttactattatcgattgttacttgtaaaggcgatactcccaccgctcacgatattagacctgctcctctagaagcgaacggcgataggtctactcggccggcgaagacggcgaacgggtaggaggagccatatgcaaccctaacggagattataagtactgggaaaaatactagtattaaggtagcgggttaagataggtggagagacactattcacgagcataagcacttagaaggtcttctcgaggagaggtaggctacggactacgttccttcttcctctagcctcgagagggagtatagatgattcgcaaaagagaatccctcctatacgctggcataactagacgacgcgtcgtcgggaaatctcgccaaccctattgcgacctccaaaaggaagattgtcgtttcatagaacgctaatactccgggtcttcccgaatcatagccgcatatcggtaagaagacggtaaaatcgcgcgattctaacaagattctgtagacttaaggctaagcactagaagcgatctcgattccggatcttaagatcatactaatagttcggtcacaccagacgacgattagccactagaagccctactccgtngaaaccgg

SEQ ID NO: 643 - DNA, 586 bp, Homo sapien
  misc_feature (1)...(586): n = A,T,C or G
ctttgtggcggcggtgtctcatttgggtggatttttgggtcgtaggaacctggtatgcagggtccgcccggaattaaaagcgggatccccaaaacgnngnttcgcaagaagagaagaatcatagcgataganctttcatagtacaaaggtaactaagaggaaaataatgcagattcagaactagttgccaaattagaactcgattaggccaaggatccgagcctggcgctatcacttcgggacttaagctacggtagagcagtcggtcctgaagcatagctcccgtaggacgtaggaaactagtccggcacggaggacatactctcgagtctcggaacgtctatttagaatataaacgcattaacctcagaaggcgccgacgcggttactctctagggaactatttcattccttccggagctcccctatttttccaacacatataccggcaaaggaaaatcttntgtcctcggtctaaagagagggaaaaaaaacgatatctaggttcgggtttatccatttaaaaanatngacgcgactactccctttcaaagggagtttccccctaggnagagttcaacngaag

SEQ ID NO: 644 - DNA, 646 bp, Homo sapien
  misc_feature (1)...(646): n = A,T,C or G
ctttgtggcggtggttgtctcatttgggtggcatttttgggtcgtaggaacctggtatngagggctatttgacttgtttctcaaatcccatggtatggtgggtggcgtgcggggtggcggtcggttcggcgggggtgggggtcgtcctccaaaggagttgctagagggcttttagtggttttagggcgggaaggggttagagcggagagacgtcgtcgtggaagcttctggcggagcgcgagaaggtagttagcgccggttcggaagattctcagaattcgagaagaggtagtggggcgcggagagagagtttctaagtctaaacgtagaggtcgtcctagtcgggccgggagtagcttttaagctagaggtcgaggtcctcgtttaggctccgggctcttcgggcagtatcctctttctcgaggaacggagcgaccgacgtcgtagccggacccgtctatccgtacgtttagagatacgctcacctccacgggcgtatatgcccgtatacgtataaacgcgtaatatactcgcgcgtaaaacacgtatacactatatacacgcatcgtacggaccgtatagcgttatacgcgcgcgtatattaatttacacttatatacgcgttaacacgatatatcacacnccg

SEQ ID NO: 645 - DNA, 654 bp, Homo sapien
  misc_feature (1)...(654): n = A,T,C or G
nccntcggcttgggtttttttctgaccccccccccccccccccccggtcgacaacgtgcccaccgttgccatcccagcatagctggttcgttctgttttattcttagtagtttagttcgcctatagtccctcgtctatcgtctatcatttaaggaggcggggctcgctctttagggcgggtatcttaggtattcttctggtttcggctgccgtctcggagtctggtccttttgctttcctttcttggtcgaacttcgtgtttgatcgcgttgtttctttggggtcgtcatacctaagggccacttcgccaacaaacaagtttgtgtagtcgtttctattagggttcgctggccggcgctcttactggttggcgatttttaacgcgtttggttttaatttgcttcctcccctagggctcgctcggtcttctctctgttcgctgctctcgtccggcctttggtgcggggatagctccggctattancgtgccgtgtccgtgtggnttttgtccaatgtgaaggcctaggggtgcgggcttctttggccatggnttcccctcttgtganccttaggggtaacgantcgtaattnaaggtcgggggttggnatacgttntangggangcctgngtccgntattccttgttttggcctn

SEQ ID NO: 646 - DNA, 645 bp, Homo sapien
  misc_feature (1)...(645): n = A,T,C or G
tccttcggcttgggtttttttctgagcccccccccccccccccccacgccaagtacacagacccaccaaaaacaacgtcaacacaacttcgggtatacggaccttaagagagaccccgtagtagaccctaccacagccatccaatagtcaaacaacaagggcgcacccaatccatccatagagctatcaaacaacggaggggaaaggaaagagcagggtcaacttagcagagatcgaagtcggcactaattcctttcaagtactcgctcggcttgtagttcggggtaaagtccgctctcaaagggccaacgaggttttaaagcgacccccgtatcgagtcttcttcgtattcattaaggcgttaaaggtacgagacctagaagagagtagaattagcccaccaaatcgcctaaaccggcaaaaacgaccaaaagtcaaagacccttacaaatatcaccttaaaacgccaaccccaaaaacgcgatcagtaacgcacgtacctttcccacgcttttctttctttcactctccaaaacaaacccgaatatttagcgcaaaaaatatccgagggagaattagaagctattacccgaaaaaaaancggananggantaaatngtggggaatanacgtttggtttttctg

SEQ ID NO: 647 - DNA, 753 bp, Homo sapien
  misc_feature (1)...(753): n = A,T,C or G
accttacctggtaccgggccccccctcgagtttttttttttccaaatacaactcagattgtatacgaaaagctgataatacattgacttttgctgtttaaatcccttgagcctttgataatgattttttttgtgttaacaattgtagtatataaaatcggattcaccatccttctgatgccatattgattagtttgattttatggtgatgggatcattgtgtgttaactgtattaagaagaaatggatttgattgactttgcatccatttttatctgtgttactttcatgttttatttaaaagcatttctggaccagaataagttaagtggtataatttgctttttacacgtttatataattgaagttagcaatgtggcaaaatctctaatggaaataaaatgcttcagaatgatgacataaatctgagctatttcttgcctggagaacaagtgttattcataataatttaatagcttctgaggtgttttgttcatgtgatgaaggcttatccaccttgtatcaattcatgggctctgctttgtttaatgtagtcaggttgttaatacnagacttaagagtcatcctactgtgataagtggtgagtgaagattacatgtcttangaaaattatactgggaatatctctgacattaatgggtttaaatgttttaaggctaggggatgatgcaatgganaanatncttccaaangtttctggttgtttatatttgnggaagncatnaaganaccg

SEQ ID NO: 648 - DNA, 383 bp, Homo sapien
  misc_feature (1)...(383): n = A,T,C or G
gatatcccggggaaatgcggaggcctttnggcttacgtgtttaccgcgtagggcaaagccttgncaaattcccggccagcggagcggcgagggtggggactcacgggaagttaaacagcctcgtcggcgtcctcgaggctccaaaaccaggctctaggcggggacgactgcagccgttatggaggccaccgcggctacggccgcggctgaggcctccccaggtggagcggtggcctggaggggaatcttgatcctgggccagccacctgtcaagaggaggcggagcgtcatgcctctggaagactggatgaatattctccaggagcctgacgaaggcgaagaagtctttgcagaggaaattgaatgctgtctgatgctacaat

SEQ ID NO: 649 - DNA, 349 bp, Homo sapien
  misc_feature (1)...(349): n = A,T,C or G
cgattgtntacnagtcttagagtaagcttaagntcgntaccgagctcggatccactagtccagtgtggtgggaattccattgtgttgggtcactagtaaatggatttagctagacanagganatttaccctattccatttagcacagtgagganaggctanacagctaggatgcaataaaaaaaattttaatgagaaatgtgtgtggtagattaattctattaatctcaagttatagattaaaaaatttaagtaccncataaatgccatttgcctttgctaangntacatttttatgaanaangaccntgcatacnnaatganatactggactttnggnacttgangga

SEQ ID NO: 650 - DNA, 306 bp, Homo sapien
  misc_feature (1)...(306): n = A,T,C or G
cattgtgttgggagcatccttccatcagctcccatgagaaattctctgttgggtttaagcaatccccaaatatatcatattgacatgaatatatcatctcctcaatgtccagcattagcagacaagatgagtgctgaagatgatataactcctacctcttatgtaggctagaggtaaagtctggctctgctgactgtggggacataccgaaaaggaatgtgggttaatatcagangacctccctgcagatccganantcagggnctggactttctggganaggaagcnnaaagttatntctgaacc

SEQ ID NO: 651 - DNA, 769 bp, Homo sapien
  misc_feature (1)...(769): n = A,T,C or G
cattgtgttgggcagggtcatttctaaggcatgggctggaagcttttatttaaaactttacatgtcttagaagcactctggttgttgctaggcagacaattttacatctcttgctataccagttgcatgaagttcatcatgcatattggctgtggaaaaccttaacagcatcatgtcataaggtttcagtaaggtttaaatgaaatcatgtattaagcacttagtatagtgcaccttaaatgttagcttcaaaacaatgacaacctaactaatgttgaaagaagcttgtgtttgtaaattatgtcttattgaaagatgtcatcaaatcctgttatttctaatcccttaaagtctctcaatgtatttctttttgccatatccaatgacaggaccttagtttaagccagtggttctctcaacttctaatccagagatacctgggtgtccccaagaccttttcagagcatccttgatgtcaaaaccattttcataataatattaaaatattatttgctcattgtactcttattctctcccaaatattcagcgagttttccagaagctatataacatgtggtaacatcttatcactctgacgattaatagaatatgngnttttggattcttgngtttaaaattttctcactttggggttctaatatggnnacgattaatagatatggnctccatgaccaganggctttaaagcantcaataatttttaagagactaagnactatcctttaaagatngngaactccatcttaat

SEQ ID NO: 652 - DNA, 267 bp, Homo sapien
  misc_feature (1)...(267): n = A,T,C or G
nnangccctttaaccattgnggcctccacgcnntggcggccgctctacaactagnggatccgcnactctagnanaangattggctcttntgggntgggccggncgggctggggcgttaagcggggctgggcgcgcgccgnggttgnacnaggcgccgccgcccncacacncccggagcaccctcnttgcngccntnccccgctcaccccgcgcgcgccgntccgctttttccncacccanagcnctntttatctntgtctcctccgg

SEQ ID NO: 653 - DNA, 501 bp, Homo sapien
  misc_feature (1)...(501): n = A,T,C or G
cccnttnacccattgctggactccaccgcggtggcggccgctctanaactagtgggatccttncnatgagatgngcganggaggacnnatttgctatnctggatggggctgantcntntagctnctctagcancagatgggttatcgaggaagatgactccaangggctanantcctatgcncatcctaaaanncanctgctgtnttcagagtacgcgacacatcatcnctnatgcattgntgancaagacgggcangtgcttatcctcagcgangatgcccttaaccangagctcgaatggacntatcaccntanaggtacanntnccgcaccacacaccngcttgcnncctgacgctggactggatcncttaggccaccaatnccccgtttnccacatncctgggacnctananatactcganggggggcccggtanccaattcgccctaatactgagccttgntacgnacgctnactnggngtcctattanaacgttg

SEQ ID NO: 654 - DNA, 710 bp, Homo sapien
  misc_feature (1)...(710): n = A,T,C or G
gcgnctttancncatgctgggctccacgcggtggcggccgctctacactagtggatcccaacactgagtccaccacagnaaaactcancaccaggcagaccccacaactgcagaatccaggctgcaattcacagactaatcntctagacccacctcagtaccagatggtaccacacagctcaaggntttaggtttgcgtggtanactcaatctctatctttcaccactgccagcctgacttcagagatcctgngctctggacagtcctcagtggcaggcaactctcaggagcctcaggnttttggcacatcccagnaccagccagctgccacaggccctgaccttntancaacactgcccatgtattccagacttctancataccacagtgccatgctgattgcatctatagangctcaggtgcncctcaaanctgtgcctgctgcagnangccccacgtctctggcatgccccaatgccatgngtggnaacanttgacttctgggcatgntggaattccctaccactgancctgaccataggngggancccatttttttcgaggggggggcccggcccccaattccnccntatagngagncgtanttacgcgcnncttactnggccngtngtttaacaacgtcnntganctggggaaaacccctggnngcnacccaaattaaacngcnttgcannacatccccctttcg

SEQ ID NO: 655 - DNA, 202 bp, Homo sapien
  misc_feature (1)...(202): n = A,T,C or G
cccctttnccctttcancccccccgttttggcngccgccnacacctactncatccacccacantcgaccacccgagcttttttccgatcccancatcnatgcngattttntctntgcntgctgngcctgcacctttgntaggtcaagcctggcccatcttcgacaacttcctcatcaccaacgatgaggcatactctgacga

SEQ ID NO: 656 - DNA, 308 bp, Homo sapien
  misc_feature (1)...(308): n = A,T,C or G
gctgntgaaagaccacaccgaaaaactctnctttccgacttccacatgatgatcngcatgtggtggtgagagacttatcatgacgacatcgcttccnaccatcgcanccnctgcccaagcccattcatggaggcctgggnanttctgtgantgacntngacnctanacnctnccactgtntgctatccagacttgnttngaatatnttattggcnaaanacanttncggaatgctgtgnttgnncattgaangatctgatcactatgagagggtgaggacnncctgctngctggcantntntaacccn

SEQ ID NO: 657 - DNA, 696 bp, Homo sapien
  misc_feature (1)...(696): n = A,T,C or G
accntttccacaatnctgnnctccccgcggtggcggccgcgtcgaccagcaacctcagctgtgggtcttgttacagtaatgagttactgtaaggaaagtgtgacatttcgagcaatttgatttgtttaaaaactagagcagtttcagggttttccttgtaaatctgtcttatgtgtcttcaatgttctttcttgaggagtagagaaaggaattgttaggaatgatgcataaaccatggcttattttatctcgctgccacccataatcagagcagattcttgggactatgaccctcatggagacatgacaattgtgtgtgtggtgggtgggagaaaagagctgggaatttttagggtctagagggtccaatcaggactattttatggagctctgctcaccaactttaagtgagcaccaggggtgngaaagcgaatcttgggntcaaaanaacaatggnaaggggtaagttggtatnctgaactggccacttcggactcttatttaactgggtattctcanttaaggaggcnngggtggtcttggcttgtnaaggaaagcctgtgcaatggaatgactttaaaaccccccattaaaaaaaaaangntataaatcttgggtcttaanaangaagcctgggttctnttancccattttncccccgggaaggnaaatnttcttaggnaanggaagggaagg

SEQ ID NO: 658 - DNA, 698 bp, Homo sapien
  misc_feature (1)...(698): n = A,T,C or G
ctggactccccgcggtggcggccgctctagaactagtggatccgtgttggctcaattctcaaggctgttgctgtgcggcctgttccccacacgtgctgctcagctcaggcaagcaccgagcttgtgttgtttcatgctcagcgtggaggcccctcctccaggtcgctgctctgtggggttcccatacactcaggctcctaggaggagtccatttagaaagccagggtttttctcagagtcttagttccttgtgctgtcatccatttcacacgacttgggccctgctcggggcaacacagcaagagaaaagacagggaaaataagagagggaccttgcacacacacgctctggaccacagagccctgtgcccagctcctctgtcaatacaggtggaatctcgtgcaggatcgcaggggtctgtgatgccaccaaagagcaggccgggacagggttaggagagaaaggagagggaagtgggggtttctcctacgcactcttatttgcagagggaaaggcgggtttgtattggggttgtcggtctttgcacccacngcacagttgtgagacacccccatcctnagatcaaagccccacatacagcttggggaaaaacaaaacnaaacaaaacaaaaacagtaaacctccatgccanttgttgggnaagttttnaatttncttccccnacccancttgcttc

SEQ ID NO: 659 - DNA, 750 bp, Homo sapien
  misc_feature (1)...(750): n = A,T,C or G
ncaanctggnctccaccgcggtggcggccgctctagactagtggatcctcctcatgggcctggatatctctgaacatatgatgaacattgcttatgaaaaattatttgtangaaaattgtgaggcctaagaatgntattttcttttagtgatggtctttgtttgcttctgtaaggnacttgtgggcactcgtaagcttggatctctttaatctaataccagntttgagattttcttggccccatagatgaattaaaactggcgtacttcttgtttacaaganggataagtctcctagggtaagtcttttggggtcccaagtcaaaaagatgagggatttaccagttctctaaccttggtagccccagactccaaactttgccttctagtcccaagaggctatcaaaaagcaaaggccatcttccaccttcttttccanaacagcacacattccagacagtacttgaaagcaggaacctccttatcccttaaaaacctcttggaancatcttccctctcttgcttctactatgcttggcccacctancattcncntttttctggaaaccggaaaaancttntgacttnngttggctacattcagcttggccccctacaatntggtttccatctgccctaangaaattttaaagggcactttttttntggcccctgactttcnntttttagggctttcccccangctttgcccctttggttaaaggggttattttccttccccttttggaag

SEQ ID NO: 660 - DNA, 849 bp, Homo sapien
  misc_feature (1)...(849): n = A,T,C or G
tcggatccactagtccagtgtggtggaattcgcggcccgcgtcgacgggcagtagtggtatgcntntctaaatgttataattatttcagaattactctgccagaaagttatgatcatacatagaagagtttgtagctaactttgaaagtagtggaaagtggttttcatgtattgtttgggttaatttaattttgattatatttggtttttagttcaggtaatttttttgttgaaaacttcaaatgacaatttcttcatggttactaaagatcactcatgtggagtagtttcagatttttttctgaatacatgtattacttttagagatgtaaagatgtgaaattactaagagagaaacccatgtgatttgtttagtggatcaaaagtcggtagctcctttgatcctaagtgccactgatagttaaatagatactgaagctatgggcaggctggattgataagaaaaaaggagacagagaaatgggaaattgggaaagaactgtgcaaataggaaaaggagagagcaacagaacagaattagtaccacagtgccgaagtgccacctcaggtacttccatctcccatctcctgaagaattcagtaacagtttgcaaatggtcaacacaatcatttagtgatcctggttgatattttcaatactttctggggatttcttggctggnttcaaaagatgatgctgatagttttattgcccctgaaggtattctgaagnttancataatttattggtcagtaaaatatttgaataaaagnggangaaggaaaatctggcntcttattttgggatntcngcngggggaangaggatataattnaccccggccttgg

SEQ ID NO: 661 - DNA, 653 bp, Homo sapien
  misc_feature (1)...(653): n = A,T,C or G
aacttaagcttggtaccgagctcggatccctagtccagtgtggtggaattcgcggccgcgtcgacctccattcgtttcttgtccttttttttcattttttctcatgttctattcactttaggtttctaagataaatattataaaataatttttacttataaattattcactgataccctgtctttaacatgtgaaatgaattcaaaaggaatcttaatgagaaataatatactcatgatgtttaatagatttgatttcgaaataataagccctctgaagtcctaagttaaaaataaagcaacttgtttgataatttttcatcaagaatgtatctgagtctctgagtaattattagtaggaatattccattatcacaattacacagtataagctatttagtctaactttaccaaaaaagggagctacttcaacactgtgtgagacttttaatgggtttgcattgggtatgcactattagcaagataacctattttacagcagtgtttnttaacctttcccatttatttgaaaggcagctaagatatagtagttaatntaangggctgatgcatttatattacatgtaganaatgggagatacnaaagggagngggggganatnttttgnattcnnaagcttcnttgncaattaa

SEQ ID NO: 662 - DNA, 646 bp, Homo sapien
  misc_feature (1)...(646): n = A,T,C or G
aaacttaagcttggtacccgagctcggatccctagtccagtgtggtggaattcgcggccgcgtcgacccagggacaggcagccagngctggggtcaccagggtcccctcttgggccctccaanagcaacagtactggcaacagctgggatttgctgagcacagactctgcagcaggctcggttgagctctctgtgcctgttccttcataccatcctcacgcccatccatgagatgggtccagctgttttcagatgagaaaatggcacaggaagctggtaagtgacagtcagaaatgaatgctggcagcttantccttggacccaccgcagtgcaggaccttgctcaacagggatcacccttgtccgccacctgttcatgaggccacccagggtttgtgtggtcatttgtctcctttcatctgcttgccttcaaccagctgggtcattagggctggggaacccagaccccacacagtccttctcccagangccagacacannctncgccacagnaaggacttcagtccccgaancaaatgtncctgggcgtanaaactgnagggnccccaatccctggtggggtactgctttgcactggnggaattcacccctcattgnnaacctttccctnttnncacccctaaac

SEQ ID NO: 663 - DNA, 650 bp, Homo sapien
  misc_feature (1)...(650): n = A,T,C or G
aacttaagcttggtacccgagctcggatccctagtccagtgtggtggaattcgcggccgcgtcgacgtcgacgcggcgngccgtttcgacgcagttgatacatattattatatactacatnggttttctagaattaaaaaattaatgtgtagtgccagccctagatgtaagttacatatatcaactctatccaattttgtcagccataaaacttacctttttcacatacttctaactctaacaatgtgagaaatgtagatcattgcaattatacccacaaggcagatggctacatgcagaatggatagcagaatctagctacttacgctagccacatggtagacgttttttcctttgtttttgcaaaattgcaatataagttgcatatcgttagagtgaaaagatgtaaagaacccatagaagccagtgatgaaggacatttatattttcacctttacaaangaccttaaaattgcctatgtggagcagaaactggaggagggcnaanccatcngtaaaaaaaattttgntnctatttggatttgggcaccattattacctccccaggtncctttttgntttaacctttcttttaaaaaaaataattcntaatttttgggcaaaaaaaaacaaggtttttatttaaattt

SEQ ID NO: 664 - DNA, 678 bp, Homo sapien; identical to SEQ ID NO: 605
  misc_feature (1)...(678): n = A,T,C or G

SEQ ID NO: 665 - DNA, 694 bp, Homo sapien; identical to SEQ ID NO: 604
  misc_feature (1)...(694): n = A,T,C or G

SEQ ID NO: 666 - DNA, 705 bp, Homo sapien
  misc_feature (1)...(705): n = A,T,C or G
tttaaaaatttagatacactangaaaattattttagtatcagaagaatatcagggggtgtagtactcatcagagctaaatgagagcgctttaaaaatgttagtttgtcttccgccatttctacagaaagctgcaatttcaggttttcaacctaataggtgatatttaagaaaaaaaaaaagcaatcgcaaatagccccactgcttttacaaatcattttttctcttctaggtatagcctgtcaggtggcctaatgtaatttttgacatctctaggaattttaatagaaccagaaatgggtgccagagatatgcctgcactaatcttaagtggggatttatgtatttctcaagcaagtgattaaagcaaaactaggcacgattgaaatcaagatcttttaggcaagaaagtcatgatgagttttanaattattttaggactctgtggctttctcttcatagaaatagaaaaaaaaattgtataaaaccacaaaaggtcctgaatagcccaagcaacactgaacaaaaagaacaaagcaggaagcaacacactaccagaattcaaattatactaccaaggtgtagtaaccaaaacagcattctattgggcntaaaatagaccnaagaccaatggaacagaataaagaacccaaaataaatccatatttttacagccagctnattatcaataaaaacnccaagaacnt

SEQ ID NO: 667 - DNA, 817 bp, Homo sapien; identical to SEQ ID NO: 603
  misc_feature (1)...(817): n = A,T,C or G

SEQ ID NO: 668 - DNA, 826 bp, Homo sapien; identical to SEQ ID NO: 602
  misc_feature (1)...(826): n = A,T,C or G

SEQ ID NO: 669 - DNA, 547 bp, Homo sapien; identical to SEQ ID NO: 601
  misc_feature (1)...(547): n = A,T,C or G

SEQ ID NO: 670 - DNA, 232 bp, Homo sapien; identical to SEQ ID NO: 600
  misc_feature (1)...(232): n = A,T,C or G

SEQ ID NO: 671 - DNA, 214 bp, Homo sapien
  misc_feature (1)...(214): n = A,T,C or G
ctccccttccntccttcgctactncncattttcnnaaatttntttcgcntatgnggaaaaacacccacattnttcanctcgcacagaacangnnggggtgtgtaaaatgaagggcttccncnctttctcttattnaanaacactnaaanagggangggctaaaacccgcgngatntctacnctatcgcgggcgcttttggngttggctagaaga

SEQ ID NO: 672 - DNA, 328 bp, Homo sapien
  misc_feature (1)...(328): n = A,T,C or G
ngancagcggngtttaaacgggcctctagactcgaggagacncctgttggatggtggatcacanntcgntactactatacaggacagagtatcggganctcttggntgttggngcctgccaaccactgctnctgttaactgcgtatctgaagggactcggactggcttcagaagaactaccggctcgaatgnaccatggatgattcncnctagttgaaaaaaaactcaggcacatgtattgccactgatgactagcgccagactnctctcggctctntaacgagcccacatgncngtgtgncncccgtgctgnctccagaagaggttc

SEQ ID NO: 673 - DNA, 223 bp, Homo sapien
  misc_feature (1)...(223): n = A,T,C or G
gggggcaaagctggctagcgtttaaacttaagcttggtaccgagctcggatcccnnagacattgtgcatgaaaatgcaaattgagtgtggtctatantgccatcntcacctnctgncngctcaaaacaacngctttctgctgcaatgggtagggctcctnacncacggtcgcnnacggaggccnncttatcctcntcggtnnggatccctngaagcatnttct

SEQ ID NO: 674 - DNA, 256 bp, Homo sapien
  misc_feature (1)...(256): n = A,T,C or G
gnggggtcntngatgagcgcgcgtaatacnatcactntcnggcgngntgggtaccgggccccccctcnaagcggccgccctttttttnttttttttcatnacatgataanntctttnttctaaacagaccacaccactanagttcctttnctttngtacggaattgagttaaagtagagnatacaatgcagggcttcnnctctatttcacattccaggntggttcngnatggatcggccctgcctctccgatgggt

SEQ ID NO: 675 - DNA, 439 bp, Homo sapien
  misc_feature (1)...(439): n = A,T,C or G
nnactagtccagtgtggtggaattccattgtgttgggcttgtatgggtttttttgtctagttntttgggaaatgttngtgttactatnttttggatatnatatatgatatgtatggcccttctatgggctcctcanacngaactcaaccattttccacaaaaccnattcctcctttcccttcatgactgagtggtgttggtactatccnggaaactgggacattgtccttcacatctntcccttanctgcctngtccnattgatgtctttgagctntganatgtctttgttaactntctcctncntctgtactgccggcanaattaagcaccatntgtcacaaaaagtattgcgttaccttcacgnatctgttngttnccatncttgctgcttctccngnggaaaataggctnttctggcaaccgaacngaanaaatac

SEQ ID NO: 676 - DNA, 587 bp, Homo sapien
  misc_feature (1)...(587): n = A,T,C or G
nggnggcctnattaagcgcgcgtaatacnactcactntggggcgaattgggtaccgggnccccctcaagttnatntgccnaacctctcttttggaataacaaaaggtttaacacatatgtcctcatagggacgcgctttcacacnttcctgacngcttcatanacntcattnctatttctcctcagnacaagttnaggcngaaggtgaggcanacnttataatttccatttcacaaatncggaaagtgaggctcaaagggnttaaaaaataacctgatacaantcatagagccggtntctggaanaagcaggagcaaagtccaggcatcctgatccaagctnggtccactgccttccactctggagaggcttcatctccgacaaaggaagggacntgagtggctgganaatctcatgggataaagacctcagnatttcatgctcctggaaatcccatgggttgaacaacaggtntttggcccgtggttctntccctttgnccatcttttaaccttggggtaaatgatggcntctntnagcnttttttttnaaagagatngaaattgaatgattattngctcattggg

SEQ ID NO: 677 - DNA, 444 bp, Homo sapien
  misc_feature (1)...(444): n = A,T,C or G
gtggggcatnattaagcgcgcgtaatacgactcactataggggcgaantgggtaccgggcccccctcgaagcggccgccctttttttttttttttactgtccaaactntctatngatntagttgaactgtncaacgatttcatgaaattctatacacanagccttcaggtccagagagtaaaacaaatttaaatttnttcaccanattgnagcagncanaagcatccnatnatatccgactacaatgaatnatatgctnanggtanctnatttacccactntggggtctttanggtctgtcacaaactattttcgtaaacatcnntttaaanttnggtgaatggacctaatnccagataantctatttnatntaccctagcatncctgtggctnactttncgggctgtgttggcntacttttaggagaaaattggtataaatnn

SEQ ID NO: 678 - DNA, 670 bp, Homo sapien
  misc_feature (1)...(670): n = A,T,C or G
actagtccagtgtggtggaattccattgtgttgggagcagtttaaaaaaaaaaaagacnaaatatacnactcttgatnaaacataaaggtacagtggtctatgaggaanagaaaaggtacctnaggatgcaaaantacctaccacatgggaaccgttngtccacactcattccnnanaaaaccgagtcctctcanttncacacgtgtacgtttcagttgggaagtgcttgccattactccnaagcctagaaccttcacgtcctgaaggttctggaaggtttttcagattgcttaaganacgcngcccttccatattcntctccactacccnggggaacggaacaaatggagctgcgacngggaagcgtcccttcccntccgaacgctttctttcaaacctgcctgccttccnggcgaatggaccggaaggtttnctngcttcctttcancccnaattacttcctgngttgaaaattggcctgttggtttgcaaatgcnggaatttgtttactttcntcatgtcctgtgttgnncnaaccggctcncttgttgcctccctttngaaaggttttcatcaggccccgccctttctcttntaanngtcctaatccggncnggaccactcggggaaaattttttcttttcgaaaagccgccccntccgtccggct

SEQ ID NO: 679 - DNA, 449 bp, Homo sapien
  misc_feature (1)...(449): n = A,T,C or G
actagtccagtgtggtggaattccattgtgttgggagtaggtctactacancctacttcccctatcatanaagancttancaacnttcatgatccccccctcntannccttttcctcanctgcntcctagtcctgtttgtcctnttcctaacantcntaaganagatnactaatnctactatctctnacctccggaanctacaanacgtctggaactattcngaccccatgcanccncatnctccatcgtcctcccagcccctncccttcctttacnttactnaacgaaggtcgacgatccctcccntacctcccnnnccattgggncccaanggnactggacctcacgantacaccnactacggggngactaagnctgnaactccttacatatntccccgttacccccngaacncagcgaacngcnacaccttggacntcaagaanta

SEQ ID NO: 680 - DNA, 670 bp, Homo sapien
  misc_feature (1)...(670): n = A,T,C or G
tttcngtgtggtggaattcgcggccgcgtcgacgagaaganggaggagganaaggagaaggagaagaaggagaanaaggaggagaaggagaagaaggagaagaaatcatcatcatcatcatccactgtctngcaactatttaagtttgcnantcccttgaaaacaggtacttttgtttcaatgtttgggaccactnctgacnatgannagaanaccaataaatgcttgatnaatgaaaaanccactttttacctgttagaaccctgaggctaagagaantgatgtgactcgacttagttaccacaaactatgatcctagcatnaattggggcatctcaacacctcaactccctgtgcaagaacagattttcaatgtctactgatgattttaaatggattanttcctctctttacttcttaagggcatgaagntttatgaaacaaaactatncagttccagacgcttaacccacatagtgttaatagtcaccttcaacacacnactaaacccccaaaaaangntttttacggngtttcgacagttttcttttctttttgacttgnttaacacccnngacaactttgtnctntttccntgaatcacanctttcnaananccaatggtncggttttttctcnttcngggcccttcccttnttnaaaaccanat

SEQ ID NO: 681 - DNA, 494 bp, Homo sapien
  misc_feature (1)...(494): n = A,T,C or G
tcatggtgtccacagtctgatgtgagcgcattaaatttaaggatctccgcccttctccttaaaactcaggacttggcaatgancctaggaagcgcccctcccctccccanccanatccaagccccggaccgctgcgnctccagctgcgcctagtgaaaccgccgaattcgaattcacactcggngggccggcgaaggtgtgcgcgcccgcgggagcgccggggcnagcccgagggactgcaagccaanaanggaggcatgggtggcggggggcgccgtctgatccaggaaggagcggaggcgccgatcacacactcttnagacgccctgcccgcgcctggccagcgcgcagnctgcaggacgcgcggagcaggaactcgctggagtttgccaagccccangnctctggaaagtntgtagctccctttcggancgnctcttctggccctttgggacgggtgtgtcattgggcgggggtctgtataagggggggac

SEQ ID NO: 682 - DNA, 263 bp, Homo sapien
  misc_feature (1)...(263): n = A,T,C or G
tgatcattcaagcgntgngcgnataacgattgctnagcccaacctttcatagggtcgttcctttgggaatnggatgtctattgaatggcagggataggggcactcggcattcgcctctggtacagttttgcatatatatcctcatcgcgagcgagcgtaggggancgttaagtttggggaaatgccnccgcatgnccctnccggagcttaaacccccaacaatncccattttnaaaaaagntttnttanttaaaaaaaaaaac

SEQ ID NO: 683 - DNA, 255 bp, Homo sapien
  misc_feature (1)...(255): n = A,T,C or G
cttgcccggcatgcacagacntntttacggacacnctactccaagngagcctgnanctgtctacggtcaanctctaaggttngncantgccacanatggcatagtcccgagggcggtnantctggantgctctctgcacttgaacntaaagcgcntttcaaganaggnctaatngcctgcctcttgacaacnaacaancccacaccnacctangaccctntangcaaggactggattctgnaaatgcaatacaca

SEQ ID NO: 684 - DNA, 922 bp, Homo sapien
  misc_feature (1)...(922): n = A,T,C or G
acccttcatttcatgtgcttctattttcctacatcttttacatgactaagggattaatgaaatcacctcttcataatcatgaccataatttcatccaacaagtactcaagtttggtgttagcactttattaatgcttacgaattctctctctctccctctttctcttttccttagtccttgcacaataaggatttttgaatgtataatatcatcttaggtaagctttcatatggttttggcatatgaagcttatgactgtcataagccataccaagcctgtggagtatggcatgattttcattacataatccaatgaaaatagacttattttaaatccctaactttgtagttttaatttgtatttcactatcttgaaattaacagctagtacttatccatcacagcagtctcctactgacatgaagcaagttgttgaatgcagtagancatgaatgaaagcatttaatgttanacaaaaatgggtgatacccaagcattctgaattatttgcatcaaggaatgggacatgtacattagtggcatcatttctaccaatatgtgacttgaattgtttttttaaaaaaagganaatgantttctcaatttgctttaaaaaattttnaaaaagttcaatggcatgctgctttgtctggacttaatttattaacaattnttaanccttccttaaggacanaattttggtgttcaggatcnccctgaagggtcttatttttnatannattccaaacccaaaaggtggtttaaaatgggngggttccccccncnaaaatttggaccggcttttttatatttaaaaaanttnccntttgngtttgaaanctnaataccaattaagggggaattttacctnccagtgggaaaaaaaaacnctngccnttnaaaaaattcccnggagncaat

SEQ ID NO: 685 - DNA, 531 bp, Homo sapien
  misc_feature (1)...(531): n = A,T,C or G
tgaggctctgtaaaactgttcctctgctaggcatacttcatattctctatattaaactcatctttaattggcatggaagattcattgttccaaatctcagatgaagatcctatattggatgcaattaagcctggcagcgccctcaaaagacagtcttgtcactgctagccacagccaggacacagtaacagttccttctagtgacccnagaccataanaaatananatctaaagaattctgactccaaaggcattagcccattcctggtattgccaattatgatagaaaaaattgccaagctcctgggacatggaaatacactcagtacatttgagaactggagaactantttccaaaatagtatgaagacatganggtgattgtagatatntgagtttggagaanttgagggaaatcngattacacatgtttactacaagagatgttnataagtaaagaaggcctgatatacaatctaacagacnantgagataaatcttaantcacaactgacntcccttttggggcgg

SEQ ID NO: 686 - DNA, 336 bp, Homo sapien
  misc_feature (1)...(336): n = A,T,C or G
ggngncctnatgagcgcgcgtaatacgatcatatagggcgaattgggtaccgggcccccctcaagaacactacaagctatgtcctcttctcanagagccctgaanttttaacatattgaaagctctnatcttgccaaanaactccacttaacttcaaaacacaccctccacacacatcatgatcaactnagatcttactgaaccagaatcctnaatggcatacttcaggaacaggggtccanagaagcagttctcaaantgcagctnaaaaagaaactgaaaacccaattcatgcaanacctagggcttatttgagagcattttccagtgcagatt

SEQ ID NO: 687 - DNA, 271 bp, Homo sapien
  misc_feature (1)...(271): n = A,T,C or G
aatctgcactggaaaatgctctaaaataagccctaggtcttgcatgaattgggttttcagtttctttttaagctgcactttgagaactgcttctctggacccctgttcctgaagtatgccatttaggattctggttcagtaagatctcagttaatcatgatgtgtgtggagggtgtgttttgaagttnagtggagttctttggcaagatcagagctttcaatatgttnaaacttcagggctctctgagaagaggacatagcttgtagtgtt

SEQ ID NO: 688 - DNA, 740 bp, Homo sapien
  misc_feature (1)...(740): n = A,T,C or G
tgatgaagcgcgcgtnntacnactcactatnggggcgaantatgggtaccgggnccccctcgaagcggccgccctttttttntttttttgtgagagtttaaataaaatatttgagtttaatttaaagtttgagtttaattaaaatatatggcatatcccaagttgggctttgcanaaagaacacttctcaggaactgttagttggtgtaccaggaactcagaagggtcctgttattaaatatatttggaaaatgcatggattctctgaanatcnctctgcatgtgagcaacacttacatcncaaaccaaaattggcattgcatacatnaaccaatatttcccaaacatttctggttatggcccaccccctttgtgtantacttattgctgttttttggaaccctggggaaattacttaaaatattcagctggaaattacaggcgttacttttaagggancaagaattacagtgactcccaaaattgcaagtgttgattactatttaagaacccaagaatttgaaagaaattttgaaaagtgaaaacnggaaatnttaaatgacttctcaaattttgaaaactcnggnaaacatctccactttggtncccttcctttaaaaattggctaaaaattntttnttatncccaccccattggaantnccccccccctggaacaattggattcccctatttcctaaaaaacggccnccccccccggggngaacnccnacnttttgn

SEQ ID NO: 689 - DNA, 635 bp, Homo sapien
  misc_feature (1)...(635): n = A,T,C or G
actagtccagtgtggtggaattccattgtgttgggattacatatacttttagcaatttttaaagaagtgtacaaagttgagatgtttcctgagctctcatatatctganaatgtcattttacatctccgtcttcacctctcaaaacttctttcaattctttggctcttaatagtaatcaacacttgcactctggagtcactgtaattcttgctcctttacagctacncctgttatttccagctgaatatttttagttatttcccagggttccaaaaaacagcaataagtactacacaaagggggtgggccataaccagaaatgtttgggaaatactggctcatgtatgcaatgccaaatctggtttgcnattgtantgttgctcacatgcagagtgaatcttcaaanaatccatgcattttccaaatatatttaataacagggaaccttctganttcctggntacaccaactaacagttcctgaaaaatgttctttctgcaaaacccaacttggggatatgccatatattttaattaaactcaaactttaaattaaactncaattattttattttaaactcctcaaaaaaaaaaaaaaaaagggggggcccttccaanggggggnccggttcccc

SEQ ID NO: 690 - DNA, 3923 bp, Homo sapien
acagaagaaatagcaagtgccgagaagctggcatcagaaaaacagaggggagatttgtgtggctgcagccgagggagaccaggaagatctgcatggtgggaaggacctgatgatacagaggaattacaacacatatacttagtgtttcaatgaacaccaagataaataagtgaagagctagtccgctgtgagtctcctcagtgacacagggctggatcaccatcgacggcactttctgagtactcagtgcagcaaagaaagactacagacatctcaatggcaggggtgagaaataagaaaggctgctgactttaccatctgaggccacacatctgctgaaatggagataattaacatcactagaaacagcaagatgacaatataatgtctaagtagtgacatgtttttgcacatttccagcccctttaaatatccacacacacaggaagcacaaaaggaagcacagagatccctgggagaaatgcccggccgccatcttgggtcatcgatgagcctcgccctgtgcctggtcccgcttgtgagggaaggacattagaaaatgaattgatgtgttccttaaaggatgggcaggaaaacagatcctgttgtggatatttatttgaacgggattacagatttgaaatgaagtcacaaagtgagcattaccaatgagaggaaaacagacgagaaaatcttgatggcttcacaagacatgcaacaaacaaaatggaatactgtgatgacatgaggcagccaagctggggaggagataaccacggggcagagggtcaggattctggccctgctgcctaaactgtgcgttcataaccaaatcatttcatatttctaaccctcaaaacaaagctgttgtaatatctgatctctacggttccttctgggcccaacattctccatatatccagccacactcatttttaatatttagttcccagatctgtactgtgacctttctacactgtagaataacattactcattttgttcaaagacccttcgtgttgctgcctaatatgtagctgactgtttttcctaaggagtgttctggcccaggggatctgtgaacaggctgggaagcatctcaagatctttccagggttatacttactagcacacagcatgatcattacggagtgaattatctaatcaacatcatcctcagtgtctttgcccatactgaaattcatttcccacttttgtgcccattctcaagacctcaaaatgtcattccattaatatcacaggattaacttttttttttaacctggaagaattcaatgttacatgcagctatgggaatttaattacatattttgttttccagtgcaaagatgactaagtcctttatccctcccctttgtttgattttttttccagtataaagttaaaatgcttagccttgtactgaggctgtatacagcacagcctctccccatccctccagccttatctgtcatcaccatcaacccctcccataccacctaaacaaaatctaacttgtaattccttgaacatgtcaggacatacattattccttctgcctgagaagctcttccttgtctcttaaatctagaatgatgtaaagttttgaataagttgactatcttacttcatgcaaagaagggacacatatgagattcatcatcacatgagacagcaaatactaaaagtgtaatttgattataagagtttagataaatatatgaaatgcaagagccacagagggaatgtttatggggcacgtttgtaagcctgggatgtgaagcaaaggcagggaacctcatagtatcttatataatatacttcatttctctatctctatcacaatatccaacaagcttttcacagaattcatgcagtgcaaatccccaaaggtaacctttatccatttcatggtgagtgcgctttagaattttggcaaatcatactggtcacttatctcaactttgagatgtgtttgtccttgtagttaattgaaagaaatagggcactcttgtgagccactttagggttcactcctggcaataaagaatttacaaagagctactcaggaccagttgttaagagctctgtgtgtgtgtgtgtgtgtgtgtgagtgtacatgccaaagtgtgcctctctctcttgacccattatttcagacttaaaacaagcatgttttcaaatggcactatgagctgccaatgatgtatcaccaccatatctcattattctccagtaaatgtgataataatgtcatctgttaacataaaaaaagtttgacttcacaaaagcagctggaaatggacaaccacaatatgcataaatctaactcctaccatcagctacacactgcttgacatatattgttagaagcacctcgcatttgtgggttctcttaagcaaaatacttgcattaggtctcagctggggctgtgcatcaggcggtttgagaaatattcaattctcagcagaagccagaatttgaattccctcatcttttaggaatcatttaccaggtttggagaggattcagacagctcaggtgctttcactaatgtctctgaacttctgtccctctttgtgttcatggatagtccaataaataatgttatctttgaactgatgctcataggagagaatataagaactctgagtgatatcaacattagggattcaaagaaatattagatttaagctcacactggtcaaaaggaaccaagatacaaagaactctgagctgtcatcgtccccatctctgtgagccacaaccaacagcaggacccaacgcatgtctgagatccttaaatcaaggaaaccagtgtcatgagttgaattctcctattatggatgctagcttctggccatctctggctctcctcttgacacatattagcttctagcctttgcttccacgacttttatcttttctccaacacatcgcttaccaatcctctctctgctctgttgctttggacttccccacaagaatttcaacgactctcaagtcttttcttccatccccaccactaacctgaatgcctagacccttatttttattaatttccaatagatgctgcctatgggctatattgctttagatgaacattagatatttaaagctcaagaggttcaaaatccaactcattatcttctctttctttcacctccctgctcctctccctatattactgattgcactgaacagcatggtccccaatgtagccatgcaaatgagaaacccagtggctccttgtggtacatgcatgcaagactgctgaagccagaaggatgactgattacgcctcatgggtggaggggaccactcctgggccttcgtgattgtcaggagcaagacctgagatgctccctgccttcagtgtcctctgcatctcccctttctaatgaagatccatagaatttgctacatttgagaattccaattaggaactcacatgttttatctgccctatcaattttttaaacttgctgaaaattaagttttttcaaaatctgtccttgtaaattactttttcttacagtgtcttggcatactatatcaactttgattctttgttacaacttttcttactcttttatcaccaaagtggcttttattctctttattattattattttcttttactactatattacgttgttattattttgttctctatagtatcaatttatttgatttagtttcaatttatttttattgctgacttttaaaataagtgattcggggggtgggagaacaggggagggagagcattaggacaaatacctaatgcatgtgggacttaaaacctagatgatgggttgataggtgcagcaaaccactatggcacacgtatacctgtgtaacaaacctacacattctgcacatgtatcccagaacgtaaagtaaaatttaaaaaaaagtga

SEQ ID NO: 691 - DNA, 882 bp, Homo sapien
  misc_feature (1)...(882): n = A,T,C or G
ttactcactatagggctcgagcggccgctgaattctgctgcagtgagctgtgattatgtccctgcactccagcctggatgacagaacacgatcatttctctaaagacaaacaaaaaacataaaataaaactagtataaggatagaagcccagggttgatttaagtctgcggaaatcataaaccataggtcagacttctcattgatgaggtacttgtgggttagaatacaattaggtatatttggtctagaaaccaggatggaattagagaataaaagactgagcaatagcatgttatagtattagaaatactatagaaataggaaaagccctgattatgactttggagttctgatccaacatctgggattatttagatattttaaaggaaaacgatgacttttagctctcaggatgttagtttcctcaaccataaaatgaagagcctcgaaaagatttcgtttaccagattatttctgaagtcaattccagttctaaaattccatcactgngcactaaggcaaattgaattgaataaagtattgggnatgcataaaatactctatttttaaaaangaatagtaattatccattggnaacagacgcantcatccagncatctcctaccctgncccatgncntatgtaganatgtanctctaatcccttaacaaaccgattttgcaaaggagcttanccttggggtacttggtcanggcaactggtctactttnaagactcatcttcacttactgggcaccaaatncctaccattgcatcaaactggggttcccatncaaggcaaaccctgngaaatctttaatcccgaaattggcgcccaattttgnggggtttccnaaaagaatcntcccccccgaggggcc

SEQ ID NO: 692 - DNA, 235 bp, Homo sapien
  misc_feature (1)...(235): n = A,T,C or G
ccgcactngtaangnccgccagngngctgnaantccgctnagcncggatccactagtccattgatggtaaaagggtagcttactggnatgtccgnctgctccanganataatacncaggacttctcanagcacttaatatgttaatataaaactncgngaaaaaagatnttcnatgaancnttcctcttaggaggtcaggngagaatagtgttaatgncattaagganagaacga

SEQ ID NO: 693 - DNA, 383 bp, Homo sapien
  misc_feature (1)...(383): n = A,T,C or G
nttatgtaagaaatgtcatatatcttttattttctttaaatcaaaataaatatgactttgagcatcccatcccatgccccatcctatcagaatggtaggaacatcaacacaaataattagtaatgcaccgcatctacattcccatgctctctttacttcttcagcattgcctaaaggcataatacacctttaattaattaattcagcctcctaatgcacattaacaaagcccctgctagactctgtccataatggnaaacctgnatgatccttgatattaacantttaaggaatgctcatggattggttncagacttaaaaaattgagggggctgaanaaaatctaangganaaatcatggaagcatttgcacatattacata

SEQ ID NO: 694 - DNA, 204 bp, Homo sapien
tctcttggctggtcagcctgaagggtggtaatgactcaccaacgctactaatccttcttcactgtcccttatttttttccctcccaggctcataactcgaggttaaactctcttttatacaagaaccctgtctgatgaagcatcatttcagaattttaagtcaacttacaaatgtggtattattcacatctgagtacaaattta

SEQ ID NO: 695 - DNA, 670 bp, Homo sapien
  misc_feature (1)...(670): n = A,T,C or G
gcaccagcccaggtgctgtttcttcacttgagctccatgaccctccctgtgtggtgggttgaacggtgacctccaaaagatatgtccacctggaacctcagaataagatcttatttggaatagtctttgtagatgtcagtaaggtaaagatttggagatgagaccctcctggattagggtaggccctaggtccactggcaggtgtgcttctcagggtctgaaaggggaagacagggccacccagaggaggagacggaggcagagacagggccacccagaggaggagacggaggcagagacagggccacccagaggaggagacggaggcagagacaggggccacccanaggaggagacggaggcagagacagggccacccagaggaggagacggaggcagagacagggccacccaaaggaggagacggaggcagaanacaggcccccccaaagaaganaccggaggcanaaaacagggccacccanaggaggagacggaggcanaaacagggccaccccaaaggaggagacggaggcaaaacagggccacccaaaaggaggaagccggaaggaaaaaacagggcccccccaaaggaggaagncggagggcnaaaaanagggccccccccaaagngagaaaaccnggnaggcnanaaaaccnggggcccnnc

SEQ ID NO: 696 - DNA, 317 bp, Homo sapien
  misc_feature (1)...(317): n = A,T,C or G
tgacccgttntttctgcaaaggagagtggggaaggagggntgggaagacaaaagttacatgttagcagggaagagaacagaattttatccacccttatctctttagtgagtgaacaaacagcccactgtcatcgtggatacatttcacttttttcacatgactaaggagctctccggagtgaagagtgagtaaatatgtttattacgcattcatttgctaagaatcatcaagaacccaaagttagagacgtttcgtggttgaactttctccctactgtctagtagaattatatggggattctggatctgctggtgcc

SEQ ID NO: 697 - DNA, 246 bp, Homo sapien
  misc_feature (1)...(246): n = A,T,C or G
ctncagctctaatcgactnctatnaggnatgatggcncgtgcngcgcgtacgtantgcttggatcctcnnanagcggacgcctactactactaaattcgcggncgcgttgactttttttgtttttttccttnacagagntntttttgtgcccttggttcttatgctcanactcngcaaaaaanatcaaaagntacnnatgaaaaacntatnccatctncanaaaggaggtgnagntattactttct

SEQ ID NO: 698 - DNA, 3674 bp, Homo sapien
agaaagtttccttttttttttttaatggtgaaaagatatacacatatttagaattagccagctgggctcagtttagattattccaattttgttggcaacatccagagcatcgtaatcaggagccagtgaaacatattccttcttctctccatcaggccaaatcacggtgttgaccttggccacatcaatgtcttagaacttcttcacagcctgtttgatctggtgcttgttggctttaacatccacaatgaacacaagtgtgttgttgtcttctatcttcttcgtggtgactcagtggtcagcggaaacttgatgatagcgtagtggtcaagcttgtatctcctgggagcgctcttccaaagatatttgggctgcctcgggagttgcagcgtcttgggccgccggaaggtgggtgacgtacggatcttctttttttgtgtggctgtggacacctttcaacactgtcttcttggcctttaaatccttcgctttggtttcggctataggaggggcaggagcttccttcttcactttcggcgccatcttgtgaaaagggaaagtttcctttctaataccattttcacttctcccgaattttgtggatcgtttcttggtatctaccccagatttcaggagtgttggctggatcttagggattgtgaagtcttcatttccctgtggtgagatctgaggcatgattttaaacagtgtgagggaaggagatctccaggcactttaatagaatggagaagcaggatgggatttgagaggaaatctgattttgaaaaaaggagaactagagttgagttcgtaattaactagcaccttaaaggtcattcagcatgcccatctgcacagtgggtgtaatcaccctacagaacaaaaacaaaaaggcaatggagaggaagctgtaaagcactgtacatgtttaactcattgttatgtaagctagccgaaggcttcacagacttgaattcatctcccaagttctcttcctgtactggaaactctgccttaggttgcttaaaacttgagaaacagaatattgcttcccctgcctgccttcttgagtacacttgcctacacaaagatgcacatccttgtttgtgtgtgtgtgtccatttgctgtgacattcttgtgaaagtcaaagtttcccagctgttgacatacacaagtttgtttggtgcaacctgtcagatgcatcccttagacaggccctttgatactctgggaaagacattggacttacagtcggaacgaaaagaaagaaatgtgatatgtatagcgtgcagtgagttggagttttacctgtattgttttaatttcaacaagcctgaggactagccacaaatgtacccagtttacaaatgaggaaacaggtgcaaaaaggttgttacctgtcaaaggtcgtatgtggcagagccaagatttgagcccagttatgtctgatgaacttagcctatgctctttaaacttctgaatgctgaccattgaggatatctaaacttagatcaattgcattttccctccaagactatttacttatcaatacaataataccacctttaccaatctattgttttgatacgagactcaaatatgccagatatatgtaaaagcaacctacaagctctctaatcatgctcacctaaaagattcccgggatctaataggctcaaagaaacttcttctagaaatataaaagagaaaattggattatgcaaaaattcattattaatttttttcatccatcctttaattcagcaaacatttatctgttgttgactttatgcagtatggccttttaaggattgggggacaggtgaagaacggggtgccagaatgcatcctcctactaatgaggtcagtacacatttgcattttaaaatgccctgtccagctgggcatggtggatcatgcctgtaatctcaacattggaaggccaaggcaggaggattgcttcagcccaggagttcaagaccagcctgggcaacatagaaagaccccatctctcaatcaatcaatcaatgccctgtctttgaaaataaaactctttaagaaaggtttaatgggcagggtgtggtagctcatgcctataatacagcactttgggaggctgaggcaggaggatcactttagcccagaagttcaagaccagcctgggcaacaagtgacacctcatctcaattttttaataaaatgaatacatacataaggaaagataaaaagaaaagtttaatgaaagaatacagtataaaacaaatctcttggacctaaaagtatttttgttcaagccaaatattgtgaatcacctctctgtgttgaggatacagaatatctaagcccaggaaactgagcagaaagttcatgtactaactaatcaacccgaggcaaggcaaaaatgagactaactaatcaatccgaggcaaggggcaaattagacggaacctgactctggtctattaagcgacaactttccctctgttgtatttttcttttattcaatgtaaaaggataaaaactctctaaaactaaaaacaatgtttgtcaggagttacaaaccatgaccaactaattatggggaatcataaaatatgactgtatgagatcttgatggtttacaaagtgtacccactgttaatcactttaaacattaatgaacttaaaaatgaatttacggagattggaatgtttctttcctgttgtattagttggctcaggctgccataacaaaataccacagactgggaggcttaagtaacagaaattcatttctcacagttctgggggctggaagtccacgatcaaggtgcaggaaaggcaggcttcattctgaggcccctctcttggctcacatgtggccaccctcccactgcgtgctcacatgacctctttgtgctcctggaaagagggtgtgggggacagagggaaagagaaggagagggaactctctggtgtctcgtctttcaaggaccctaacctgggccactttggcccaggcactgtggggtggggggttgtggctgctctgctctgagtggccaagataaagcaacagaaaaatgtccaaagctgtgcagcaaagacaagccaccgaacagggatctgctcatcagtgtggggacctccaagtcggccaccctggaggcaagcccccamagagcccatgcaaggtggcagcagcagaagaagggaattgtccctgtccttggcacattcctcaccgacctggtgatgctggacactgcgatgaatggtaatgtggatgagaatatgatggactcccagaaaaggagacccagctgctcaggtggctgcaaatcattacagccttcatcctggggaggaactgggggcctggttctgggtcagagagcagcccagtgagggtgagagctacagcctgtcctgccagctggatccccagtcccggtcaaccagtaatcaaggctgagcagatcaggcttcccggagctggtcttgggaagccagccctggggtgagttggctcctgctgtggtactgagacaatattgtcataaattcaatgcgcccttgtatccctttttcttttttatctgtctacatctataatcactatgcatactagtctttgttagtgtttctattcmacttaatagagatatgttatacttaaaaaaaaaaaaaaaaa

SEQ ID NO: 699 - DNA, 2051 bp, Homo sapien
  misc_feature (1)...(2051): n = A,T,C or G
ggaccaggggctgaagtgaacccccagcacagcacagctgctctataaaaacgtggccagacttttttttttgaagcaagtccctgttcttgttcgtcctgactagtcccatcagggccctggatcccaagactcagcatccaaggtcccctccaggaatcctggcagctcagcatactttatcctgtttcatctgagagcaaaaatgtaaaattggatgcacagaaaagtgactcaaagtgcttaatgactagaagaaatctaggagcagcaagaagagcaggacaaacaggccaggcggtgtcaggagcccaggtctccagctgganggaacgtcaaccctgcagtgggagcaggggccctttgcacatcctaggcacagatggtaatgtagacaccacaggtaagctgggcttggtacctacccctccccggattcagaaagaaaccaaacaaggagctttgtgtggaatgaaacctcctttcctcccagaagcactgctgactgtttggtggttgccatttgtggcagtgagcccttgtttgttctgaggttgggctggtttctcctcttggccctgccctacagatcataaaggagaacagcaagacgtccccagcaaacatccacagatggccttggaaataagtcaccttcctcaccctgcaggaatgccagtgaacatattgctgacatcttggagctcagtacctcatagtgtaacggcgtcagtagatctgcctgtgctgggacttcctgtactacccattcctgaggggcgatgcttctgcagggcctgtgacttggtgcacaacttcagacaccatcatcttgcagcagcaccgcaccctcactagccagggtgttgatgacttcctcaaggccaaggccacattcaaggcttcggacttcattgatgcgcttgtgctgagcaaggtggcttctccgggatcttaattcaggaggtagaatggagcttgagatcaagtgtctgatcaagcctcagtgtatgggcgctgttcatcctctggtgctgaagcagccaagagacccaagtctgcctggctgcctcttaggatatgacagcagagccagtggcctctactagatcctgtacaacctcacaaaacacccagacatcgggagtgctgccagcctgtgatgcaagagtcctaatcctgaagacattgaatgacctgtcgttgtgctgtttttaccaaaaaggatcatgaggatcagagaggaaaagtcacttgcccaaagtcacacagctgaacagtggtggagttcaactttgaccgtgggctgtctggcccccaaggtgtatgcttgcttctctcccaagagactcctttcttatcaggctcaaatgaatgaaaggaggatgttaaagacaacgccattattgacgagatcactcccaagcggattggagattgtcccaatatttagacctatagcaaggccttgggagaaatggtggtgcagcaggagagcaggaacctaaccattgccatcctaaggccctccattgtgtggagcaacgtggcaccagcttttcctgggttgggttgataatctaaatggatgtagccgactcattattgcggtatgtatagggatgaagaagtaactgtaatgtagtggaggaatagtaagaaaattcttagtgctggcttagcttaattgatccaaaaacataaatgctactttactatcaattgaagcatattatttcaattattctggttataatatggaggcaggatgaaattgtttttattcttttagaatttttttttatcaggaaaacagaggtaaagtgctatcaattactatttaagagttctattttgaaaagtgagaattaaggatttttcttttctttttaaaaaaaacttttttaaaaattaaaaataaaagaagcaaaagtcttaggaaaatgaagcaagtagccctgccactctatgtacagtaataacaatatctgtcccagttattatgtacaatattataaaaaatgtcgcagacagtaaaaaaaaaaaaaaaa

SEQ ID NO: 700 - DNA, 2841 bp, Homo sapien
  misc_feature (1)...(2841): n = A,T,C or G
gcagagcacagcatagctgctttaccaaatcatggccagactgcttctgtaagcaggcccctgatcctgttccacctcactggacaggacctcccaactggggcctccagctacccccaccagcatcccttggccaatggaaatttgaaatgttcctgggacagagctcctggagagaggggcaggccaccacctttgctgtttgggtgactagccgttctggcctgcaggctttggagagcccaagctgacaaggggtagaagaggtgcctcagcacagcacagccacgctacgaaaacatggccagactcttgtttaagtcagtccccgaacacatttctagtcagtgggtgaagtctttcaaccagggtctctggctaccttgactgctgttctctggccgacagaggtctcaggcctccctgagtcagagctcccggggggaggaccagattgtcatctttgctgtttgggtgacccagccatttcagccttagggcttcagagtgtctgaggtagccaggggctgaagtgaacccccagcacagcacagctgctgtataaaaacgtggccagactttttctttaagcaagtccctgttcttattcctcctgactaggtaagacttctcaacttgcctccagccacatcttattggtgtgttcagattggcaacaggtttgtacctcagtggtacagagctcccagaggaaggggtaggctatcatcttccctggaaaatacgagtcaattagggacttgaggggacccccagcattccacagcagcccttcagaaaagtggccagactctgtacttgatgggcagatcctcctggcctgtgtctctagccagcccaccactggagctatcaagccagtagcaactcagcagttccttggacagagcttccaggagcaaatgaaatcctttctgccactgcctttgcagtgaactgcccttgctatcctcagaagatatatcacgggagcaaagaccctaagtgccatatcaacacctccaataagctgcagttgacccaaagaacaagccaatccatctcccacaggttccacacacactccactactcatcaccagacagggaaccctggcttgggcccacagcacagaccctccatcctgggccgattacactgagtgattgctaactcacatgtctctgggatggagcacccaggagacaagcaaagtggtggagcagcaagtcaggtgatgtggagcccagagggcagggagagctatctctctgggctccacttgcccttgtgagacactttgtcccagcactccttagtctgcttgcctctcccagggccccagcctggccacacctgcttacagggcactctcagatgcccataccatagtttctgtgctagtggaccgtaccatatcagtggagagctgcagcaaggtggcccntacggccacgcaccagcctgcacattacctctccatactgcagccctttatatggaaacttcctacatcactttgctgtgtgtgtttacacaggtggattttgctttacttgcactgacagcacacaggagggcagcacacaccccaacccacatcaactgccattaaagaaaagaaatttcagcccataatttcatgtccagcaaaattaggcatcataagtgaaggagaaataagatccttttcagacaagcaaatgctgagggaattcaatatcaccagatctaccttacaagagctcctgaaggaagcactaaatatggaaagaaaaaaccatcaccagccactacaaaaatgcagtgaagaacgcagtgaattacgcagtccagtgatgctaaaaaccaaccacatacgttaagtctgcaaaataaccagctgacagcatgacgacaggataaatccacacataccattactaaccttaaatgaaaatgggctaaatgctcccattgaaagacatggggcaagctggataaagaaccaagacccactggagtatgctgtcttcaagaaacccatctcacatgcggtggcatacataggctcaaaataaaggaatggagaaaaatatttcaagcaaatggaaaacagaaaaaagcaggtgttgcactcctactttctgacaaaacagactatgcgaataaagataaaaaagagaaggacattacaaaggtggtcctgacctttgatatatctcattgcttgataccaacctgggctgttttaattgcccaaanccaataggataatttgctgaggttgtggagcttctcccctgcagagagtccctgatctcccaaaatttggttgagatgtaaggttgattttgctgtacaactccttttctgaagttttactcatttccaaaaaggaaggcaagttttcctgcttccatgacgatggagagcaggcatctcctttcctgagtttcagcttgcttctgacagggaaggtgagtgtaagttttttccagcttctaagatggcagagaacgatcaccagcctgagccttatttccaggtaagtagctgaattagagttttgtcttaaaatttttccttaatgattaaaatgtaagattacccaccagctgcttttaatttctcccttagcattagaacactcagtaatcatatgaattgtgcatttgtttgttttgcttaactctttctgtttgtttatgtttggggttttattgttgttgtttcacttttctcccatctcttcctgacttggtcaaatccaaaggaatgttcgaaattgtggggagcaaggcatctgaaatggctaaaactcctgtggctgcaaaaaatagaaataaaaaaaaaaaaaaa

SEQ ID NO: 701 - DNA, 3228 bp, Homo sapien
  misc_feature (1)...(3228): n = A,T,C or G
tccgccccattgacgcaaatggcggtaggcgtgtacggtgggaggtctatataagcagagctctcnggctaactagagaacccactgcttactggcttatcgaaattaatacgactcactatagggagacccaagctggctagcgtttaaacttaagcttggtaccgagctcggatccactagtccagtgtggtggaattccattgtgttgggcaggaaacaagcaaagtggtggagcagcaagtcaggtgatgtggagcccagaggtcagggatggctgtctctctagggtccacttgcccttgtgagacactttatcccagcactttaggaatactgaggtcataccagccacatcttatatgcaagattgcccagcagagatcaggtccgagagttccctttttaaaaaaaggagacttgcttaataaaagaagtctagccacgtttgtgtagagcggctgtgctgtgctgggggttcacttttgagagagttctcctctgagacctgatctctggaggctgggcaatcttgcacttgagatggggctggtctgatctcagcactccttagtctgctcgcctctcccatggccccagcctggccacacctgcttacggggcactcttagatgcccacaccataacttccatgctagtggactgtaccatatcagtggagagctgcagcaaggtggcccctagagccacgcaccagcctgcacattgcctctccatacggcagccctttatttggaaacttcctaaatcactttgctgtgtgtgtttacacgggtgtgttttgctttacttgccctgagagcacacgggagtgcagcacacaccccaacccacatcaactgccattaaagaaaagaaatttcagcccagaatttcatgtccagcaaaattaagcatcataagtgaaggagaaataagatccttttcagacaagcaagtgctgagggaatttggtatcaccagatctaccttacgagagctcctgaaggaagcactaaatatggaaagaaaagatcatcacctgctactacaaaaacacactgaagtacacagtccaatgatgctaaaaagcaagcacatatgtaagtctgcaaaataaccagctgacagcatgacgacaggataaaatccacacataccattactaaccttaaatgtaaatgggctaaatgctcccattgaaagacacggggcaagctgggtaaagaaccaagacccactggagtatgccgtcttcaagcaacccatctcacgtgcagtgccatacataggctcaaaataaaggaatggagaaaaatatttcaagcaaatggaaaacagaaaaaaggtgttgcactcccagtttctgacaaaacagactctaccaataaagataaaaaaagagaaggacattacaaaggtggtcctgacctttgataaatctcattattgcttgataccaacctgggctatttgtattgcccaaacgaataggataatttgctgaggttgtggagcttctccccttcacagagtccctgatctccgaaaatttggttgagatgtaaggttgattttgctgtacaactccttttttgaagttttactcatttccaacaaggaaggcaagttttcctgcttccattgacaaaggagagcaggcacctcctttcctgagtttcagcttgcttctgacagggaaggagctttgagatttgaatactggcctgctgggttttggacgtgcattgggcctgtggtcccatttgtgttatttttctgggaaatttcttccctttggagtgagaaagcttacccaatgcctgtaccatcatcgtaccttaaaagaactccattttaagttcagggactccttggcagaagagaccgtagccttgtatcagatcataaaggagaagagcaagaggtccccggcaaacatccacagatggccttggaaataagtcaccttgctcaccctgcaggaatgccagtgaacttattgctgacatcttggagctcagtaccctcatagtgtaacggcgtcagcagatctgcctgtgctgggacttcctgtactacccattcctgaggggcgatgcttctgcagggcctgtgacttggtgcacaacttcagacaccatcatcttgcagcagcaccgcaccctcactagccagggtgttgatgacttcctcaaggccaaggccacattcaaggcttcggacttcattgatgcgcttgtgctgagcaaggtggcttctccgggatcttaattcaggaggtagaatggagcttgagatcaagtgtctgatcaagcctcagtgtatgggcgctgttcatcntctggtgctgaagcagccaagagacccaagtctgcctggctgcntcttaggatatgacagcagagccagtggcctctactagatcctgtacaacctcacaaaacacccagacatcgggagtgctgccagcctgtgatgcaagagtcctaatcctgaagacattgaatgacctgtcattctgctgtttttaccaaaaaggatcatgaggatcagagaggaaaagtcacttgcccaaagtcacacagctgaacagtggtggagttcaactttgaccgtgggctgtctgaccccaaggtgtatgcttgcttctctcccaagagacaactttcttatcaggctcaaatgaatgaaaggaggatgttaaaggtaggatctctgaagcctgtgccagtggaaccgcagctcatggctggcacctgtgttctcattcttacctcattaagagtaaagtttattgagtttattgaatttaagtatctttagtgagatcatatattattagtaagaactgggaccaaacagattttctgactctaaaagagagattttcacagaaacagatatatacctgtaagtatacagacacgcatacacacatttctttactgctcataaaaattagtccttattagaatgtgggatgtataaatgtaagagaattttcatgttaaaattgacagatacatttttaaattgtcctaaaataaatttaattatttttnttttagaattttccattattaatgttatttttatgagaaactatataactttattgataatacatacaataaccctttgtttttcaaattgaaaatacagtgtattttgcaaataactaagtcctaattttgtattaaaattttaaattttcaaaaaaaaaaa

SEQ ID NO: 702 - DNA, 4894 bp, Homo sapiens
ctgcacgcgctggctccgggtgacagccgcgcgcctcggccaggatctgagtgatgagacgtgtccccactgaggtgccccacagcagcaggtgttgagcatgggctgagaagctggaccggcaccaaagggctggcagaaatgggcgcctggctgattcctaggcagttggcggcagcaaggaggagaggccgcagcttctggagcagagccgagacgaagcagttctggagtgcctgaacggccccctgagccctacccgcctggcccactatggtccagaggctgtgggtgagccgcctgctgcggcaccggaaagcccagctcttgctggtcaacctgctaacctttggcctggaggtgtgtttggccgcaggcatcacctatgtgccgcctctgctgctggaagtgggggtagaggagaagttcatgaccatggtgctgggtgagtcactacatcctccttccttcctgttccagatacatgccacctggcatgtgggacaggagtacctctgccctgggagctgcttggagggagaggtggtctgctgggaaggcattgctgggcaggagggtgaccctgggctgagggggcacaccaagagaaagaagagaataccaaggacataccccagtcacctctggatccctggtcctgcacagagcctggctcataggagacactggagaaatgctcctaacctttggctagcccttttataatttatagcgattatctcatttaatgcttacaaccaccatttgaggtgatccattttacagagaaggaagcagaggcttttaagaggttaggtaagtcttagccaaagccaaatagcagctgaacagtagagctgggactccatcaaggtctcccagccggagcttgctcctacccctaggacaaggggtggactcctgactctgcagataaattctacaaaagccacagaaggcaagtagtaaccattgtgtgacaacccctcacccccaggaagaggggcccctgtgaggattgcaggctctggagtcacactgcttgttgaaacgctgcctcttaccctccctaggtctgcgcctttgaataagtatcacttcttagttgctccatgcctcagtttgtccatctgaaaatgggggcatctgtaatgcctgtgttatgaggagtaaattacagcatccctgtgaagacgtagcacagtgtcgagtacggaatgttatttccatccttctcacggagcttggttccccttccccttgccctttacttgtcccagccattgactcatactacttcccttcttgcaggcattggtccagtgctgggcctggtctgtgtcccgctcctaggctcagccagtgaccactggcgtggacgctatggccgccgccggcccttcatctgggcactgtccttgggcatcctgctgagcctctttctcatcccaagggccggctggctagcagggctgctgtgcccggatcccaggcccctggagctggcactgctcatcctgggcgtggggctgctggacttctgtggccaggtgtgcttcactccactggaggccctgctctctgacctcttccgggacccggaccactgtcgccaggcctactctgtctatgccttcatgatcagtcttgggggctgcctgggctacctcctgcctgccattgactgggacaccagtgccctggccccctacctgggcacccaggaggagtgcctctttggcctgctcaccctcatcttcctcacctgcgtagcagccacactgctggtggctgaggaggcagcgctgggccccaccgagccagcagaagggctgtcggccccctccttgtcgccccactgctgtccatgccgggcccgcttggctttccggaacctgggcgccctgcttccccggctgcaccagctgtgctgccgcatgccccgcaccctgcgccggctcttcgtggctgagctgtgcagctggatggcactcatgaccttcacgctgttttacacggatttcgtgggcgaggggctgtaccagggcgtgcccagagctgagccgggcaccgaggcccggagacactatgatgaaggtaaggccttggcagccagcagaggctggtgtgggagccgcccaccagagacgacactcggggctgtgtctgggctggtgcctctccatcctggccccgacttctctgtcaggaaagtggggatggaccccatctgcatacacggcttctcatgggtgtggaacatctctgcttgcggtttcaggaaggcctctggctgctctaggagtctgatcagagtcgttgccccagtttgacagaaggaaaggcggagcttattcaaagtctagagggagtggaggagttaaggctggatttcagatctgcctggttccagccgcagtgtgccctctgctcccccaacgactttccaaataatctcaccagcgccttccagctcaggcgtcctagaagcgtcttgaagcctatggccagctgtctttgtgttccctctcacccgcctgtcctcacagctgagactcccaggaaaccttcagactaccttcctctgccttcagcaaggggcgttgcccacattctctgagggtcagtggaagaacctagactcccattgctagaggtagaaaggggaagggtgctggggagcagggctggtccacagcaggtctcgtgcagcaggtacctgtggttccgccttctcatctccctgagactgctccgacccttccctcccaggctctgtctgatggcccctctccctctgcaggcgttcggatgggcagcctggggctgttcctgcagtgcgccatctccctggtcttctctctggtcatggaccggctggtgcagcgattcggcactcgagcagtctatttggccagtgtggcagctttccctgtggctgccggtgccacatgcctgtcccacagtgtggccgtggtgacagcttcagccgccctcaccgggttcaccttctcagccctgcagatcctgccctacacactggcctccctctaccaccgggagaagcaggtgttcctgcccaaataccgaggggacactggaggtgctagcagtgaggacagcctgatgaccagcttcctgccaggccctaagcctggagctcccttccctaatggacacgtgggtgytggaggcagtggcctgctcccacctccacccgcgctctgcggggcctctgcctgtgatgtctccgtacgtgtggtggtgggtgagcccaccgaggccagggtggttccgggccggggcatctgcctggacctcgccatcctggatagtgccttcctgctgtcccaggtggccccatccctgtttatgggctccattgtccagctcagccagtctgtcactgcctatatggtgtctgccgcaggcctgggtctggtcgccatttactttgctacacaggtagtatttgacaagagcgacttggccaaatactcagcgtagaaaacttccagcacattggggtggagggcctgcctcactgggtcccagctccctgctcctgttagccccatggggctgccgggctggccgccagtttctgttgctgccaaagtaatgtggctctctgctgccaccctgtgctgctgaggtgcgtagctgcacagctgggggctggggcgtccctctcctctctccccagtctctagggctgcctgactggaggccttccaagggggtttcagtctggacttatacagggaggccagaagggctccatgcactggaatgcggggactctgcaggtggattacccaggctcagggttaacagctagcctcctagttgagacacacctagagaagggtttttgggagctgaataaactcagtcacctggtttcccatctctaagccccttaacctgcagcttcgtttaatgtagctcttgcatgggagtttctaggatgaaacactccaccatgggatttgaacatatgaaagttatttgtaggggaagagtcctgaggggcaacacacaagaaccaggtcccctcagcccacagcactgtctttttgctgatccacccccctcttaccttttatcaggatgtggcctgttggtccttctgttgccatcacagagacacaggcatttaaatatttaacttatttatttaacaaagtagaagggaatccattgctagcttttctgtgttggtgtctaatatttgggtagggtgggggatccccaacaatcaggtcccctgagatagctggtcattgggctgatcattgccagaatcttcttctcctggggtctggccccccaaaatgcctaacccaggaccttggaaattctactcatcccaaatgataattccaaatgctgttacccaaggttagggtgttgaaggaaggtagagggtggggcttcaggtctcaacggcttccctaaccacccctcttctcttggcccagcctggttccccccacttccactcccctctactctctctaggactgggctgatgaaggcactgcccaaaatttcccctacccccaactttcccctacccccaactttccccaccagctccacaaccctgtttggagctactgcaggaccagaagcacaaagtgcggtttcccaagcctttgtccatctcagcccccagagtatatctgtgcttggggaatctcacacagaaactcaggagcaccccctgcctgagctaagggaggtcttatctctcagggggggtttaagtgccgtttgcaataatgtcgtcttatttatttagcggggtgaatattttatactgtaagtgagcaatcagagtataatgtttatggtgacaaaattaaaggctttcttatatgtttaaaaa

SEQ ID NO: 703 - DNA, 2904 bp, Homo sapiens
gtctatgccttcatgatcagtcttgggggctgcctgggctacctcctgcctgccattgactgggacaccagtgccctggccccctacctgggcacccaggaggagtgcctctttggcctgctcaccctcatcttcctcacctgcgtagcagccacactgctggtggctgaggaggcagcgctgggccccaccgagccagcagaagggctgtcggccccctccttgtcgccccactgctgtccatgccgggcccgcttggctttccggaacctgggcgccctgcttccccggctgcaccagctgtgctgccgcatgccccgcaccctgcgccggctcttcgtggctgagctgtgcagctggatggcactcatgaccttcacgctgttttacacggatttcgtgggcgaggggctgtaccagggcgtgcccagagctgagccgggcaccgaggcccggagacactatgatgaaggaaggcctctggctgctctaggagtctgatcagagtcgttgccccagtttgacagaaggaaaggcggagcttattcaaagtctagagggagtggaggagttaaggctggatttcagatctgcctggttccagccgcagtgtgccctctgctcccccaacgactttccaaataatctcaccagcgccttccagctcaggcgtcctagaagcgtcttgaagcctatggccagctgtctttgtgttccctctcacccgcctgtcctcacagctgagactcccaggaaaccttcagactaccttcctctgccttcagcaaggggcgttgcccacattctctgagggcgttcggatgggcagcctggggctgttcctgcagtgcgccatctccctggtcttctctctggtcatggaccggctggtgcagcgattcggcactcgagcagtctatttggccagtgtggcagctttccctgtggctgccggtgccacatgcctgtcccacagtgtggccgtggtgacagcttcagccgccctcaccgggttcaccttctcagccctgcagatcctgccctacacactggcctccctctaccaccgggagaagcaggtgttcctgcccaaataccgaggggacactggaggtgctagcagtgaggacagcctgatgaccagcttcctgccaggccctaagcctggagctcccttccctaatggacacgtgggtgctggaggcagtggcctgctcccacctccacccgcgctctgcggggcctctgcctgtgatgtctccgtacgtgtggtggtgggtgagcccaccgaggccagggtggttccgggccggggcatctgcctggacctcgccatcctggatagtgccttcctgctgtcccaggtggccccatccctgtttatgggctccattgtccagctcagccagtctgtcactgcctatatggtgtctgccgcaggcctgggtctggtcgccatttactttgctacacaggtagtatttgacaagagcgacttggccaaatactcagcgtagaaaacttccagcacattggggtggagggcctgcctcactgggtcccagctccccgctcctgttagccccatggggctgccgggctggccgccagtttctgttgctgccaaagtaatgtggctctctgctgccaccctgtgctgctgaggtgcgtagctgcacagctgggggctggggcgtccctctcctctctccccagtctctagggctgcctgactggaggccttccaagggggtttcagtctggacttatacagggaggccagaagggctccatgcactggaatgcggggactctgcaggtggattacccaggctcagggttaacagctagcctcctagttgagacacacctagagaagggtttttgggagctgaataaactcagtcacctggtttcccatctctaagccccttaacctgcagcttcgtttaatgtagctcttgcatgggagtttctaggatgaaacactcctccatgggatttgaacatatgaaagttatttgtaggggaagagtcctgaggggcaacacacaagaaccaggtcccctcagcccacagcactgtctttttgctgatccacccccctcttaccttttatcaggatgtggcctgttggtccttctgttgccatcacagagacacaggcatttaaatatttaacttatttatttaacaaagtagaagggaatccattgctagcttttctgtgttggtgtctaatatttgggtagggtgggggatccccaacaatcaggtcccctgagatagctggtcattgggctgatcattgccagaatcttcttctcctggggtctggccccccaaaatgcctaacccaggaccttggaaattctactcatcccaaatgataattccaaatgctgttacccaaggttagggtgttgaaggaaggtagagggtggggcttcaggtctcaacggcttccctaaccacccctcttctcttggcccagcctggttccccccacttccactcccctctactctctctaggactgggctgatgaaggcactgcccaaaatttcccctacccccaactttcccctacccccaactttccccaccagctccacaaccctgtttggagctactgcaggaccagaagcacaaagtgcggtttcccaagcctttgtccatctcagcccccagagtatatctgtgcttggggaatctcacacagaaactcaggagcaccccctgcctgagctaagggaggtcttatctctcagggggggtttaagtgccgtttgcaataatgtcgtcttatttatttagcggggtgaatattttatactgtaagtgagcaatcagagtataatgtttatggtgacaaaattaaaggctttcttatatgtttaaaaa

SEQ ID NO: 704 - DNA, 4034 bp, Homo sapiens
aaccagcctgcacgcgctggctccgggtgacagccgcgcgcctcggccaggatctgagtgatgagacgtgtccccactgaggtgccccacagcagcaggtgttgagcatgggctgagaagctggaccggcaccaaagggctggcagaaatgggcgcctggctgattcctaggcagttggcggcagcaaggaggagaggccgcagcttctggagcagagccgagacgaagcagttctggagtgcctgaacggccccctgagccctacccgcctggcccactatggtccagaggctgtgggtgagccgcctgctgcggcaccggaaagcccagctcttgctggtcaacctgctaacctttggcctggaggtgtgtttggccgcaggcatcacctatgtgccgcctctgctgctggaagtgggggtagaggagaagttcatgaccatggtgctgggcattggtccagtgctgggcctggtctgtgtcccgctcctaggctcagccagtgaccactggcgtggacgctatggccgccgccggcccttcatctgggcactgtccttgggcatcctgctgagcctctttctcatcccaagggccggctggctagcagggctgctgtgcccggatcccaggcccctggagctggcactgctcatcctgggcgtggggctgctggacttctgtggccaggtgtgcttcactccactggaggccctgctctctgacctcttccgggacccggaccactgtcgccaggcctactctgtctatgccttcatgatcagtcttgggggctgcctgggctacctcctgcctgccattgactgggacaccagtgccctggccccctacctgggcacccaggaggagtgcctctttggcctgctcaccctcatcttcctcacctgcgtagcagccacactgctggtggctgaggaggcagcgctgggccccaccgagccagcagaagggctgtcggccccctccttgtcgccccactgctgtccatgccgggcccgcttggctttccggaacctgggcgccctgcttccccggctgcaccagctgtgctgccgcatgccccgcaccctgcgccggctcttcgtggctgagctgtgcagctggatggcactcatgaccttcacgctgttttacacggatttcgtgggcgaggggctgtaccagggcgtgcccagagctgagccgggcaccgaggcccggagacactatgatgaaggtaaggccttggcagccagcagaggctggtgtgggagccgcccaccagagacgacactcggggctgtgtctgggctggtgcctctccatcctggccccgacttctctgtcaggaaagtggggatggaccccatctgcatacacggcttctcatgggtgtggaacatctctgcttgcggtttcaggaaggcctctggctgctctaggagtctgatcagagtcgttgccccagtttgacagaaggaaaggcggagcttattcaaagtctagagggagtggaggagttaaggctggatttcagatctgcctggttccagccgcagtgtgccctctgctcccccaacgactttccaaataatctcaccagcgccttccagctcaggcgtcctagaagcgtcttgaagcctatggccagctgtctttgtgttccctctcacccgcctgtcctcacagctgagactcccaggaaaccttcagactaccttcctctgccttcagcaaggggcgttgcccacattctctgagggtcagtggaagaacctagactcccattgctagaggtagaaaggggaagggtgctggggagcagggctggtccacagcaggtctcgtgcagcaggtacctgtggttccgccttctcatctccctgagactgctccgacccttccctcccaggctctgtctgatggcccctctccctctgcaggcgttcggatgggcagcctggggctgttcctgcagtgcgccatctccctggtcttctctctggtcatggaccggctggtgcagcgattcggcactcgagcagtctatttggccagtgtggcagctttccctgtggctgccggtgccacatgcctgtcccacagtgtggccgtggtgacagcttcagccgccctcaccgggttcaccttctcagccctgcagatcctgccctacacactggcctccctctaccaccgggagaagcaggtgttcctgcccaaataccgaggggacactggaggtgctagcagtgaggacagcctgatgaccagcttcctgccaggccctaagcctggagctcccttccctaatggacacgtgggtgctggaggcagtggcctgctcccacctccacccgcgctctgcggggcctctgcctgtgatgtctccgtacgtgtggtggtgggtgagcccaccgaggccagggtggttccgggccggggcatctgcctggacctcgccatcctggatagtgccttcctgctgtcccaggtggccccatccctgtttatgggctccattgtccagctcagccagtctgtcactgcctatatggtgtctgccgcaggcctgggtctggtcgccatttactttgctacacaggtagtatttgacaagagcgacttggccaaatactcagcgtagaaaacttccagcacattggggtggagggcctgcctcactgggtcccagctccccgctcctgttagccccatggggctgccgggctggccgccagtttctgttgctgccaaagtaatgtggctctctgctgccaccctgtgctgctgaggtgcgtagctgcacagctgggggctggggcgtccctctcctctctccccagtctctagggctgcctgactggaggccttccaagggggtttcagtctggacttatacagggaggccagaagggctccatgcactggaatgcggggactctgcaggtggattacccaggctcagggttaacagctagcctcctagttgagacacacctagagaagggtttttgggagctgaataaactcagtcacctggtttcccatctctaagccccttaacctgcagcttcgtttaatgtagctcttgcatgggagtttctaggatgaaacactcctccatgggatttgaacatatgaaagttatttgtaggggaagagtcctgaggggcaacacacaagaaccaggtcccctcagcccacagcactgtctttttgctgatccacccccctcttaccttttatcaggatgtgcctgttggtccttctgttgccatcacagagacacaggcatttaaatatttaacttatttatttaacaaagtagaagggaatccattgctagcttttctgtgttggtgtctaatatttgggtagggtgggggatccccaacaatcaggtcccctgagatagctggtcattgggctgatcattgccagaatcttcttctcctggggtctggccccccaaaatgcctaacccaggaccttggaaattctactcatcccaaatgataattccaaatgctgttacccaaggttagggtgttgaaggaaggtagagggtggggcttcaggtctcaacggcttccctaaccacccctcttctcttggcccagcctggttccccccacttccactcccctctactctctctaggactgggctgatgaaggcactgcccaaaatttcccctacccccaactttcccctacccccaactttccccaccagctccacaaccctgtttggagctactgcaggaccagaagcacaaagtgcggtttcccaagcctttgtccatctcagcccccagagtatatctgtgcttggggaatctcacacagaaactcaggagcaccccctgcctgagctaagggaggtcttatctctcagggggggtttaagtgccgtttgcaataatgtcgtcttatttatttagcggggtgaatattttatactgtaagtgagcaatcagagtataatgtttatggtgacaaaattaaaggctttcttatatgtttaaaaa

SEQ ID NO: 705 - DNA, 6976 bp, Homo sapiens
gaagctggaccggcaccaaagggctggcagaaatgggcgcctggctgattcctaggcagttggcggcagcaaggaggagaggccgcagcttctggagcagagccgagacgaagcagttctggagtgcctgaacggccccctgagccctacccgcctggcccactatggtccagaggctgtgggtgagccgcctgctgcggcaccggaaagcccagctcttgctggtcaacctgctaacctttggcctggaggtgtgtttggccgcaggcatcacctatgtgccgcctctgctgctggaagtgggggtagaggagaagttcatgaccatggtgctgggtgagtcactacatcctccttccttcctgttccagatacatgccacctggcatgtgggacaggagtacctctgccctgggagctgcttggagggagaggtggtctgctgggaaggcattgctgggcaggagggtgaccctgggctgagggggcacaccaagagaaagaagagaataccaaggacataccccagtcacctctggatccctggtcctgcacagagcctggctcataggagacactggagaaatgctcctaacctttggctagcccttttataatttatagcgattatctcatttaatgcttacaaccaccatttgaggtgatccattttacagagaaggaagcagaggcttttaagaggttaggtaagtcttagccaaagccaaatagcagctgaacagtagagctgggactccatcaaggtctcccagccggagcttgctcctacccctaggacaaggggtggactcctgactctgcagataaattctacaaaagccacagaaggcaagtagtaaccattgtgtgacaacccctcacccccaggaagaggggcccctgtgaggattgcaggctctggagtcacactgcttgttgaaacgctgcctcttaccctccctaggtctgcgcctttgaataagtatcacttmttagttgctccatgcctcagtttgtccatctgaaaatgggggcatctgtaatgcctgtgttatgaggagtaaattacagcatccctgtgaagacgtagcacagtgtcgagtacggaatgttatttccatccttctcacggagcttggttccccttccccttgccctttacttgtcccagccattgactcatactacttcccttcttgcaggcattggtccagtgctgggcctggtctgtgtcccgctcctaggctcagccagtgaccactggcgtggacgctatggccgccgccggcccttcatctgggcactgtccttgggcatcctgctgagcctctttctcatcccaagggccggctggctagcagggctgctgtgcccggatcccaggcccctggagctggcactgctcatcctgggcgtggggctgctggacttctgtggccaggtgtgcttcactccactggaggccctgctctctgacctcttccgggacccggaccactgtcgccaggcctactctgtctatgccttcatgatcagtcttgggggctgcctgggctacctcctgcctgccattgactgggacaccagtgccctggccccctacctgggcacccaggaggagtgcctctttggcctgctcaccctcatcttcctcacctgcgtagcagccacactgctggtggctgaggaggcagcgctgggccccaccgagccagcagaagggctgtcggccccctccttgtcgccccactgctgtccatgccgggcccgcttggctttccggaacctgggcgccctgcttccccggctgcaccagctgtgctgccgcatgccccgcaccctgcgccggctcttcgtggctgagctgtgcagctggatggcactcatgaccttcacgctgttttacacggatttcgtgggcgaggggctgtaccagggcgtgcccagagctgagccgggcaccgaggcccggagacactatgatgaaggtaaggccttggcagccagcagaggctggtgtgggagccgcccaccagagacgacactcggggctgtgtctgggctggtgcctctccatcctggccccgacttctctgtcaggaaagtggggatggaccccatctgcatacacggcttctcatgggtgtggaacatctctgcttgcggtttcaggaaggcctctggctgctctaggagtctgatcagagtcgttgccccagtttgacagaaggaaaggcggagcttattcaaagtctagagggagtggaggagttaaggctggatttcagatctgcctggttccagccgcagtgtgccctctgctcccccaacgactttccaaataatctcaccagcgccttccagctcaggcgtcctagaagcgtcttgaagcctatggccagctgtctttgtgttccctctcacccgcctgtcctcacagctgagactcccaggaaaccttcagactaccttcctctgccttcagcaaggggcgttgcccacattctctgagggtcagtggaagaacctagactcccattgctagaggtagaaaggggaagggtgctggggagcagggctggtccacagcaggtctcgtgcagcaggtacctgtggttccgccttctcatctccctgagactgctccgacccttccctcccaggctctgtctgatggcccctctccctctgcaggcgttcggatgggcagcctggggctgttcctgcagtgcgccatctccctggtcttctctctggtcatggaccggctggtgcagcgattcggcactcgagcagtctatttggccagtgtggcagctttccctgtggctgccggtgccacatgcctgtcccacagtgtggccgtggtgacagcttcagccgccctcaccgggttcaccttctcagccctgcagatcctgccctacacactggcctccctctaccaccgggagaagcaggtactcattggccagtgggtggagtcagggtgggaggggtggtctgggtttttgggaggccaactagctcagaacctggtatctggcaagcaactttggagaatgcttctttgaatcagagaagaagcttatcctagccccagggccagaggcttgggctgcagaacagtgtagattagattctgggaatgacttcctggggtcaggactgtgtagcacttgaatggatgattgcaggaaatgcaaaatacgatagtgggaatcccgaagggtcaggccagcaggagccctaggcttctaggctggttgttctatggagaggcagggcgctgaatcagatgacccctgggccattcagcctcagcagacgggagtgggaatggtccagccttagcaacacctttcttcagggagcagcaacctgacttagcctgtatcctactctggtctctgagatggggcaggctccttcctaccccctttctttctggcttatttttcttttctgtctaattcccttttcttttcctgcatccctcctttgcctccttccctttctccttccccttccccttcccctgtggcagatatctgagcttgacacctgacccactcacttgggcactgtgtaagttgtggggacctccttcttggttggccctacactaaccagcccctccaggggcccctttccttgggaagccacctaacccaggtagtgtggtcatccttgtcccctccactgacctcactgagctacaaacctgggtgctggactctgccttgaggggcatgaagttggggtgtcccaagggaggaggagatgcaggactgctctcatagagctctcagactgtagggaagacctgcccctgcgtctcgtagcacttgaggagaggagtaggtaagttcgtagctgagaggctggttaactgagtaggtagctgcaggggtgagaggtatggaggggaggggctaaggttttggttgggggagcctggtccctgagacccctgttagcccactgataaccttcttcagccttcactcttctgcttgcctgggctgggggcagggggctggcatcagcggccaggcctgagtatgtgctgtcgtgccagggaacgttctggggctagccatcttctccagatggaggagcatgtctgtcctcggaccactccagactccaacctcagcggacattcctggggtggcaggcagggaggagaagtcctgggaggccccttcctaacagcagctgatggcagacttggcactgcacgctgtctgcctgttcctttgcccacttgttgagctgcatggtgagccgtgggcttccctggtgtcaggtttgagctctgccatggctcccacctcgcaaatgcagccaactcaactcttctggcatggggacaatgttggataagacctggccttgtccttaaataggaggctctgggccatcaagggcaggggttggggggatggtggtcgaccagtcactctgatctaagtcagacagcaggaaggaagtgagaagccttcaacattagcacagctggggctgggggaggtgggaagagggacattcctcctgcttggggtctactggattctccctgccccaaggctggggacaagggagctcatggcagggcagctaccctagtggcatctgggaccccagagaggcagagcttctctgcaccgggcaatgaggatttccagatgtcggagtggagggcaggcaggaaggaaggttaggagagcctgcgtggggtttgggccatcaggggccctgccttggcttttgttcctctgttctgtgcatctcttaccaccgtcttcattccccctgtgtcttttccttaccttggagctctgttctctctgatctgtgatattgagtttgtctgcctcttacctgttctaagaggctagaggagacctagacttctgggttcacatttgtccccgccctaccccgttacccttctcccactcctgaggaagggtcctggttagacttggaccaagtagggtctccatcttctctcctgctcctgattctcatgaagtcccattgcccctgggatggaggcaagggtctgttctcacagctggggtggtgccagtgctgggtacacacctgtcctcttccccttttcttcacccctctgccttaggtgttcctgcccaaataccgaggggacactggaggtgctagcagtgaggacagcctgatgaccagcttcctgccaggccctaagcctggagctcccttccctaatggacacgtgggtgctggaggcagtggcctgctcccacctccacccgcgctctgcggggcctctgcctgtgatgtctccgtacgtgtggtggtgggtgagcccaccgaggccagggtggttccgggccggggcatctgcctggacctcgccatcctggatagtgccttcctgctgtcccaggtggccccatccctgtttatgggctccattgtccagctcagccagtctgtcactgcctatatggtgtctgccgcaggcctgggtctggtcgccatttactttgctacacaggtagtatttgacaagagcgacttggccaaatactcagcgtagaaaacttccagcacattggggtggagggcctgcctcactgggtcccagctccccgctcctgttagccccatggggctgccgggctggccgccagtttctgttgctgccaaagtaatgtggctctctgctgccaccctgtgctgctgaggtgcgtagctgcacagctgggggctggggcgtccctctcctctctccccagtctctagggctgcctgactggaggccttccaagggggtttcagtctggacttatacagggaggccagaagggctccatgcactggaatgcggggactctgcaggtggattacccaggctcagggttaacagctagcctcctagttgagacacacctagagaagggtttttgggagctgaataaactcagtcacctggtttcccatctctaagccccttaacctgcagcttcgtttaatgtagctcttgcatgggagtttctaggatgaaacactcctccatgggatttgaacatatgaaagttatttgtaggggaagagtcctgaggggcaacacacaagaaccaggtcccctcagcccacagcactgtctttttgctgatccacccccctcttaccttttatcaggatgtggcctgttggtccttctgttgccatcacagagacacaggcatttaaatatttaacttatttatttaacaaagtagaagggaatccattgctagcttttctgtgttggtgtctaatatttgggtagggtgggggatccccaacaatcaggtcccctgagatagctggtcattgggctgatcattgccagaatcttcttctcctggggtctggccccccaaaatgcctaacccaggaccttggaaattctactcatcccaaatgataattccaaatgctgttacccaaggttagggtgttgaaggaaggtagagggtggggcttcaggtctcaacggcttccctaaccacccctcttctcttggcccagcctggttccccccacttccactcccctctactctctctaggactgggctgatgaaggcactgcccaaaatttcccctacccccaactttcccctacccccaactttccccaccagctccacaaccctgtttggagctactgcaggaccagaagcacaaagtgcggtttcccaagcctttgtccatctcagcccccagagtatatctgtgcttggggaatctcacacagaaactcaggagcaccccctgcctgagctaagggaggtcttatctctcagggggggtttaagtgccgtttgcaataatgtcgtcttatttatttagcggggtgaatattttatactgtaagtgagcaatcagagtataatgtttatggtgacaaaattaaaggctttcttatatgtttaaaaaaa

SEQ ID NO: 706 - protein, 123 aa, Homo sapiens [sequence omitted]

SEQ ID NO: 707 - protein, 150 aa, Homo sapiens
MVQRLWVSRLLRHRKAQLLLVNLLTFGLEVCLAAGITYVPPLLLEVGVEEKFMTMVLGESLHPPSFLFQIHATWHVGQEYLCPGSCLEGEVVCWEGIAGQEGDPGLRGHTKRKKRIPRTYPSHLWIPGPAQSLAHRRHWRNAPNLWLALL

SEQ ID NO: 708 - protein, 371 aa, Homo sapiens [sequence omitted]

SEQ ID NO: 709 - DNA, 141 bp, Homo sapiens
  misc_feature (1)...(141): n=A,T,C or G
tacggcgtggtgcggagggcggtaccccacaaataacacnnacaccccatcctatctgtgtccacanataaantgactcattcctctcctcgcatancccactntcccctngcgataccgtaacnaancccttcccccttt

SEQ ID NO: 710 - DNA, 196 bp, Homo sapiens
  misc_feature (1)...(196): n=A,T,C or G
cnatccttcncntacacccatgangtccatgtcgcacgtccacctcccctcaaaacttgggtccncatccacccgtcactctccccntaancnataaccccttttngcgaatagaccccaccttancaatnggtttttcnttttttgtccctnggnccgngcgattcaanaaattgaaggcccanaaaaaccccct

SEQ ID NO: 711 - DNA, 177 bp, Homo sapiens
  misc_feature (1)...(177): n=A,T,C or G
ntacntcnctccnaatgaaattcgaanctcggttacccgggggnattccgattaggngcgtantctcggatgtgcagtcacaagtcttttgctaatncttataattntcnctaccctttcttcnacaatactgctatcctanttnttctntcncctctctcccannttactaaccac

SEQ ID NO: 712 - DNA, 185 bp, Homo sapiens
  misc_feature (1)...(185): n=A,T,C or G
aaacgnaccanngccaacgatangtgttggngttggttgcggttgttcctcttatntgcactggttgtccgtgtcgcacgganggccacgtccctctgncntgagtancacatagcatccacgtttagtcgactntnccgggcggccgctctacccntntatngattcttattaaaantcggatc

SEQ ID NO: 713 - DNA, 172 bp, Homo sapiens
  misc_feature (1)...(172): n=A,T,C or G
nntggtcgcctgngcgtntactctaaaggatntactatncatatggantcnaanacgactcactacacggcnctctncggagccnnggtcagtgcctnctnggagaccttctctggggcaggangagcactnggtatgttcacgtatcncttcntaaanatacnnccctccg

SEQ ID NO: 714 - DNA, 112 bp, Homo sapiens
  misc_feature (1)...(714): n=A,T,C or G
nttgcgtgcctggacgtntactctgcangatctactactcatgngaattctaantacggactcactatncggcancgcaggcgcagcagggaangggtcacctcccagtctc

SEQ ID NO: 715 - DNA, 326 bp, Homo sapiens
  misc_feature (1)...(326): n=A,T,C or G
tactctanaggatctncgngtcatntggattctatntcgactcactctagggctcnagcngtcngccgggcaagttattcggatcgtcgggntccgagcttcgcaattaantgtgccatcgttctncaacgttcctgactnggaanccccngcngttcngatccncnggtacctagctccanntcccccgtnctccttctggngtntcatnaangaggaccnccctcgatcncccttccttaatctgcncacnctgaacgnccaatggacatngtgcgtttaatntannaggcccgnttcgngtgcccttcccgtnanntcagctc

SEQ ID NO: 716 - DNA, 122 bp, Homo sapiens
  misc_feature (1)...(122): n=A,T,C or G
nntgcgtcgcctgngcgtntactctagatgatctgantagtcatatggattctaatacgactcannatagggctctagcgnggatncngattcgtcntccngattcantgacnccggtanca

SEQ ID NO: 717 - DNA, 203 bp, Homo sapiens
  misc_feature (1)...(203): n=A,T,C or G
cntgcatgcctgcaggtcgactctagaggatctactagtcatatggatcgagcggccgcccgggcaggtgtnaatgataaanatgcatcatactancctacagaanggagagataatgttngntggaccangttggttttcttgcgtgtgtgtggcagtagtaagttattagtttttanaatcantaccgccctccgcaccac

SEQ ID NO: 718 - DNA, 168 bp, Homo sapiens
  misc_feature (1)...(168): n=A,T,C or G
ggcaggangatcncttgagccccngaggtcgaggctacagtgagccangagtgcactactgtnncgccctccgcatncacgngtggtccgatccccgggtaccganctnganttcactgganttctttttaancgtnttgantggtacnaccctcgantccctggctg

SEQ ID NO: 719 - DNA, 210 bp, Homo sapiens
  misc_feature (1)...(210): n=A,T,C or G
cancgtcgncataacacgtattttntgatnaagattctnactgacccatnaantctacntctcaagctcttncanngtccagtnaanggaatgtgtatnngtngggatnccacanaaaaaaganatntcggncgcttcattantcatccttcttacccanntctctngatncncagtntgancntgaacgcacactacnggatntctcca

SEQ ID NO: 720 - DNA, 131 bp, Homo sapiens
  misc_feature (1)...(131): n=A,T,C or G
tccatcctaatacgactcactatagggctgccaacctgccatccactactgaggaagacccgnanacttaggggctcactgcgagccaccggccacaggtcgtatagggcaaagcacgnggaagcacccct

SEQ ID NO: 721 - DNA, 121 bp, Homo sapiens
  misc_feature (1)...(121): n=A,T,C or G
tccatcctaatacgactcactatagggccgntgantnctggcgaaaggcttacaattaagnaggaaaaanganccaacaactaaaaaaaanncggncgtgncagcttngatgactngtcca

SEQ ID NO: 722 - DNA, 246 bp, Homo sapiens
  misc_feature (1)...(246): n=A,T,C or G
anctggagtcgcgcgctgcagtcacattgtggatccanaaaatcggcacaagctctcntggnttcntcgatatgaanaacactaatcccatgtngtntgngtctccgtgattcatccctcgcacnggtccccntccnaaccnttgcataggtgttatgttgtantctccccagtgcacaaagattnacactctctcantgtctganatatgcacgagttcattgtcctgtcnccgtnaacatcaag

SEQ ID NO: 723 - DNA, 160 bp, Homo sapiens
  misc_feature (1)...(160): n=A,T,C or G
cctccggaaaatccaantagagtaantncnctctaatccggggnaattggnggggtnnatacgtcctcctccccccagntaggattnanaaaaggnctcccagancaaaanctccaaagtgnatcnantagccgtncccganatncaacgcccctacgtc

SEQ ID NO: 724 - DNA, 156 bp, Homo sapiens
  misc_feature (1)...(156): n=A,T,C or G
tnanccnatatacaccaaattctgattctaaantcccacccaagggaaaaaagttgagaagagcctttccacttttctactaataaaaaaatgcaccagcccctaccannagtgnggaaaacctccttaggcccttgnntggaacaancgaaaatc

SEQ ID NO: 725 - DNA, 347 bp, Homo sapiens
  misc_feature (1)...(347): n=A,T,C or G
aganggttntatncatgctgtactcgcgcgcctgcagtcgacactagtggatccaaagaattcggcacgagagacggtgcgcgatggaccgagggccccagccggngaggcgccgccgccgagcccgcggncagacgccccatcagtagcgtccgcaccgggnagccgcggntctcgcccgagccgtgggcgcgcccgaggggcgggctcgcctcccgccgtccctcgcagctctgccgggcccgagcccgcgccgtcgccgccgccgncttgccgctcggnccgcgcggnccggnaaacgcggtcgaggtctggatgnggcanngcccgcncctntcgctgagcct

SEQ ID NO: 726 - DNA, 162 bp, Homo sapiens
  misc_feature (1)...(162): n=A,T,C or G
ttgggtgggttgggtgggggnaaatttncccatttgggtgggtttgggggggnaaatacttcccgccttttnggtncccaaaganacnaagggggagtcccttnatagaggnagngcgatncntcncaacnacntngactttgnccatggggagnaaggtgg

SEQ ID NO: 727 - DNA, 120 bp, Homo sapiens
  misc_feature (1)...(120): n=A,T,C or G
gtgtgggtggggaattccattgtggttgggggnaaatctccgcttgtccaaagnacagggggggtcncttanagngnagggggttcctccccaccacttgncttgnccattgngagnaag

SEQ ID NO: 728 - DNA, 130 bp, Homo sapiens
  misc_feature (1)...(130): n=A,T,C or G
gacccactgcagcgttnaacttagcttggaccgagctcggatccctagtccgtgtggtggaattccatgtgtcgagagaggggcaaatacnctccaanacancnccctcatgctcnacacatattcgcat

SEQ ID NO: 729 - DNA, 182 bp, Homo sapiens
  misc_feature (1)...(182): n=A,T,C or G
cngactgctngcgtttaaacttaagcnaggtaccgaacggggatnnacgactantgatcggctggctgcttccagtcgattanatttgtgaaaaagctgaaccncngccngttaagggggannatgcaaaanatncatccnnctgccccntaaactgntctntccnagggaaaaaanggaag

SEQ ID NO: 730 - DNA, 678 bp, Homo sapiens
  misc_feature (1)...(678): n=A,T,C or G
cactcncactccggacctaggcncttcaccactgctctcttcctcctcctcctcctcntcctcggggctgggggaccttccccagtgaccatctcactttggctgaancccactcggggcagcctgagtttggggctcttggccttctcaccctcctcggccccctccttggcccgcaccaggccaaaccggggcagccgtaccttgagcttgtgtccggcctctccctccccctctgccacctggtactcggcatggttgcccccgggatggcgagagctccacgtcgggcagtgagaagcagaaagtacgctcggcccctgggggctgctcctcagcaccctcgccccccaccctagctctggcccccagtgtgggcaacttcagcctcagcccaccctcgcctgtggccgcctcgcccgcctgtgcctctcggcttagccccacgtccaactcaagctggggcactgtcacggtgggcatcttaaagacaccctcacccaccagcagctcaccacctgcaacctgggctccaggcaaaaaaagggtcacctggggcanctgaaccctgtacctgctgtgccctctgctgaanggaatgttatctgaacctgctgccctgggggtactgccttcccaaaaccgggtcaantccacctgttggaaggnaaatncccc

SEQ ID NO: 731 - DNA, 135 bp, Homo sapiens
  misc_feature (1)...(135): n=A,T,C or G
gagatccgacgtcacccccttccggcggcccaagacgctgcaactcccgaggcngcccaaatatctttggaagagcgctcccagcccaacacaatggaattccaccacactggnntagtggatccgagctaagcc

SEQ ID NO: 732 - DNA, 660 bp, Homo sapiens
  misc_feature (1)...(660): n=A,T,C or G
gcttggtaccgagctnggatccctagtaacggccgccagtgtgctggaattcggctttcttcaatcagntnacgagctgcatggtctgctaacattgtcataattgctggcatagattactgaaaataaagaaaaaaaattgaagctgcctatcaagttttggtattatcaaaaacttcctacaagttattttacttcaaccatgttattacaaatattttaatgaatactttagagactttaattacaaaaaactgagatagtaaaagcaagtaataaaagctgaaattacttagctatttgataattacataaattattatggtccattcaacttttctagtgtttagtttatacaccaggaagactttcctattctactaacatttataaagtatgctaacctattatttaaacgcatccactattaggattttatggcctaaaacgtgatacagttcagtatcttgatgtcaaaactttttaagcaagtagggattaagttcaagtgaatgtgattttctttcttcccagtagggtcttctgaataactcagnaaagctcacttccattatcttactttataaaaaaatgctataagacagaatgggccgacgtggnggctccacctgtatccacctttggaggcgagnggcgaat

SEQ ID NO: 733 - DNA, 836 bp, Homo sapiens
  misc_feature (1)...(836): n=A,T,C or G
aattaatgactttttttccgccctgccaagctagtttgtctaaatataatgtaaagaaattagctactcattttctggtccacgaaggttcctaaaatgggaagaagtggagatctgaccttgttagttctaaatacactaaactgggagtgccatggatggctttcaggatgtcctgaatcctctataattgtatacaaaatcgtgagtttttaaaaactgggttagagctattggttcctcagagtctcaggcatcttagacccccaaaaaggttaaggactactgacttaaccaattaggtttgagtggcattggctttgaagaaaagcagaggaaagatatattttataattctgggcaacaaaaaagtggatgtgtgccagcatcttagagtagaatcctcttaaaaggatagcactgcatatgaactagtaggttttaaccagtgcatatttaggcgaagtagctcatttttctgttagaattcttttttatttgggaatgggcaagcttttacagcttttaccttgccaatgaatacctggaatttaaaaaatcttgttaggcatattgcccataaagttttttttcctagatcatatattcagtaaatatgtttgtagctttatttcaatcccccaattcattgagggttgaaacaatttgaatggtttgagtgtagaagctaagttatttctgtagaggctaagggcatttataccaanatatgttagacttgnggntcctgttaaccatgctgtanacaataggaattactgtatatccacattttaattttaacatcttctgctttgntgntggtttgagangga

SEQ ID NO: 734 - DNA, 694 bp, Homo sapiens
  misc_feature (1)...(694): n=A,T,C or G
nagtnctatttncactaaactgngagtgccttggatggctttcaggatgtcctgaatcctctataattgtatacaaaatcgtgagtttttaaaaactgggttagagctattggttcctcagagtctcaggcatcttagacccccaaaaaggttaaggactactgacttaaccaattaggtttgagtggcattggctttgaagaaaagcagaggaaagatatattttataattctgggcaacaaaaaagtggatgtgtgccagcatcttagagtagaatcctcttaaaaggatagcactgcatatgaactagtaggttttaaccagtgcatatttaggcgaagtagctcatttttctgttagaattcttttttatttgggaatgggcaagcttttacagcttttaccttgccaatgaatacctggaatttaaaaaatcttgttaggcatattgcccataaagttttttttcctagatcatatattcagtaaatatgtttgtagctttatttcaatcccccaattcattgagggttgaaacaatttgaatggtttgagtgtagaagctaagttatttctgtagaggctaagggcatttataccaagatatgttagacttgtggttcctgttaaccattgctgtagacaataggaattactgtatatccacattttaatttttaacatcattctgtc

SEQ ID NO: 735 - DNA, 126 bp, Homo sapiens
  misc_feature (1)...(126): n=A,T,C or G
ncnttgaaacnggttgaccagacttcaggcctgtgcgctcaatcgtggagaatctcgtgccgaattcggcacgagtctctctctctctctctctctctctctctctctctntctctctctctctct

SEQ ID NO: 736 - DNA, 165 bp, Homo sapiens
  misc_feature (1)...(165): n=A,T,C or G
cagaagcctttaaaccggttngaccagacttcaggcctgtgcgctcaatcgtggagaatctcgtgccgaattcggcacgagtctctctctctctctctctctctctctctctctctctctctctctctctctctctctctctctctctctctctctctctctctc

SEQ ID NO: 737 - DNA, 125 bp, Homo sapiens
  misc_feature (1)...(125): n=A,T,C or G
ggnagcccctttaaccgtttgtccagacttcaggcctgtgcgctcaatcgtggagaatctcgtgccgaattcggcacgagtctctctctctctctctctctctctctctctctctntctctctct

SEQ ID NO: 738 - DNA, 137 bp, Homo sapiens
  misc_feature (1)...(137): n=A,T,C or G
ggagncncttgancaggatgaccgacttcaggcctgtgcgctcaatcgtggagaatctcgtgccgaattcggcacgagtctctctctctctctctctctctctctctctctctctctctctctctctctctctctct

SEQ ID NO: 739 - DNA, 970 bp, Homo sapiens
  misc_feature (1)...(970): n=A,T,C or G
aggcctatttaggtgacactatagaacaagtttgtacaaaaaagcaggctggtaccggtccggaattcgcggccgcgtcgacggcccttngtgccactagntctttcattcttcccccccatcaatcagtgaactttttagcctactcaaagctttgctccaatgcataggatttatgattgtggggatttccagataatataaatattcaacatgaatattttaaattaaggcatgagacatttttcctaactgagcatagccatgaacctctcacgtctgttcctctgtgtcagtttgtancactgaatacagcagccctcctaaaagtccaggcagtgcacaggtcttgacatgatgaagtgacgtgttgctatggtgattttgcagctggccaaatagtcactggttgattttacccagcaggagatttttgcaaaaatttcctgggtgagagtgaaatcaaactcctattttgnttctcctctgcaagctgnagttaagatggattaatgagtacttttagattaattaactctgaagagaaaatgggagaaaagtgaggaaggttgttggcagaagtcattgctggaatccttctgaagggagtactgacttcacttgcaaagacnagagactanaagacaatgaagttaaacttggcctgtctctcatatgatagatgctgagagtcaggntcagggaaatttaattctgtcatacgcatatnggattatgtggtcatggatttgttggcactaaccngcctntaatcagnataagaaaagtgttttggtaganaaagaaaattatggcccagaaaaacctggaanacttggaaaaaatgntngggggccttgggtggtggtctnaaaanaccccctggggatntttaaaccaaaantgaagaagggaaaaatntttccccntntttttnttttttgcccccttgggattggnttttntttcc

SEQ ID NO: 740 - DNA, 739 bp, Homo sapiens
  misc_feature (1)...(739): n=A,T,C or G
gntgtcnaaaaagcaggctggtaccggtccggaattcgcggccgcgtcgacggcccttggtgccactagttctttcattcttccccnccatcaatcagtgaactttttagcctactcaaagctttgctccaatgcataggatttatgattgtggggatttccagataatataaatattcaacatgaatattttaaattaaggcatgagacatttttcctaactgagcatagccatgaacctctcacgtctgttcctctgtgncagtttgtagcactgaatacagcagccctcctaaaagtccaggcagtgcacaggtcttgacatgatgaagtgacgtgttgctatggtgattttgcagctggccaaatagtcactggttgattttacccagcaggagatttttgcaaaaatttcctgggtgagagtgaaatcaaactcctattttgtttctcctctgcaagctgnagttaanatggattaatgagtacttttagattaattaactctgaagagaaaatgggagaaaagngaggaaggttgttggcagaagtcattgctggaatccttctgaagggagtactgacttcacttgcaaagacaagagactanaagacaatgaagttaaacttggcctgtctntcatatgatagatgcttgagagtacaggntcagggaaattttaattctgncatacgcatattggattatgtgggtcatggctttgtttggcncctaacc

SEQ ID NO: 741 - DNA, 1171 bp, Homo sapiens
  misc_feature (1)...(1171): n=A,T,C or G
gccttgnggtgacactatagaacatgtttgtacaaaaaagcaggctggtaccggtccggaattcgcggccgcgtcgacggcccttnntgccactagttctttcattcttcccccccatcaatcagtgaactttttagcctactcaaagctttgctccaatgcataggatttatgattgtggggatttccagataatataaatattcaacatgaatattttaaattaaggcatgagacatttttcctaactgagcatagccatgaacctctcacgtctgttcctctgtgtcagtttgtagcactgaatacagcagccctcctaaaagtccaggcagtgcacaggtcttgacatgatgaagtgacgtgttgctatggtgattttgcagctggccaaatagtcactggttgattttacccagcaggagatttttgcaaaaatttcctgggtgagagtgaaatcaaactcctattttgtttctcctctgcaagctgtagttaagaagggattaatggagtactttttaagaattaaattaacctcttgaaagaagaaaaaatgggggaagaaaaaaagtggaagggaaaagggnttggttttgggccnaaaaaaaagttccaantttnggcnttggggaaaaattccccnttttccttggnaaaaggggggnaaggttaanccttgggaacctttttccnnccttttnggcccaaaaggggaacccanggggaaagaacctttaggnaaaggaaacccatttgggaangggtttnaaaaccnttngggcccccgggccctcctccaanaagggaaaaaaaaaggcctggaaaangtaccagggtttcangggnaaaanttaaaattcttggccaatancnccataattgggaattatgggggggccatgggcttttggtttgggcncttaaccccgcnttttaaattcaaannaaaaaaaagnggtttggaaaannaaanaaaaaaaattnaanggncccnaaaaaaaaccctggaaaacctttggaaaaaaattngnnggggggccntttggttgggggggtttnaaaaaaccccctngggggttttttaagcccaaaagggggggaggggnaaaanggtncccttnttttttttttnngccccccttggggaatggnttanttcanggggccc

SEQ ID NO: 742 - DNA, 739 bp, Homo sapiens; identical to SEQ ID NO: 740
  misc_feature (1)...(739): n=A,T,C or G

SEQ ID NO: 743 - DNA, 610 bp, Homo sapiens
  misc_feature (1)...(610): n=A,T,C or G
ctgtccttatttctttagcaaaaatttcccaagagaagaattgctgggataatgcacatttaaatttttgatagacattcccaaatattatacctgtttttgagacctttaattcctgttgtcaaattgccctatatatggagtaataaacacgatttaaagaaatgaggactaaaaaaagattatatataacccaacataaaggcaacctcttaggcgttgacagaaactgacaactttttatctgtgggtgcgatccattataagtaacctgagcaccttattttttctttttaaactctaggtaggatacccgaggtccacaaatttttcataagaaatattttttctctgccctatgagattttaaaaaatattatactgcttcaattgcatcaaaagaaatggaccctaatatctatgatgaaggatttggagttagaagacctgagtttcaattttggcatggctgtttgtctagctctgngatcttggacaggtcaattgacttggcttaatcttctcatccatttagnggagacagcaccactattcacaggactattgncngaattaccagacaatagcataggngaaaatataangcctt

SEQ ID NO: 744 - DNA, 127 bp, Homo sapiens
  misc_feature (1)...(127): n=A,T,C or G
ttnacctccctggaccgggccccccttccccgggcggntcccccgggctgcaggaattctgcacgagggagagagagttngagagagagagagagagagagagagagagagagananagagagagag

SEQ ID NO: 745 - DNA, 458 bp, Homo sapiens
  misc_feature (1)...(458): n=A,T,C or G
gatatcccgggattcgcggccgcgtcgacgtggcctctagtttgtcctggtccaaagcagggaagctgggctacgtcctgcccaggtcagccttaggttaagggctgcctgggggagggaacttcctgggccttcgggtctctgtgcactggggtggctcctgtggcccagaatgccctggagaagggtcctactggaagcgaaggtgcagggcagcagggcctgaggcgcaggagctggtggaggctcccagcacaggtcgccgccccagtcacatcactgctgatggtggggggacttggggagtttcccccgagaatgggaggtctcacagtccccgtgctgcaatgctgtcggtgcactgngncngcaatgtgctcatggncacttgctttttctctgtggccccggccgatttatccagcanngcacccctcttctnctctccgganaaagcc

SEQ ID NO: 746 - DNA, 893 bp, Homo sapiens
  misc_feature (1)...(893): n=A,T,C or G
aagcaggctggtaccggtccggaattcgcggccgcgtcgacgtggggagttagctctctggaccccgtcatagagtaagtcatcgatagagcatttgcttgatggggacttccagaaggccanngaaagtcctgccgacttcctggggaagcccatccgcacgtggggtgagggtccccanatggaagcagctgtgtatgcagggagggggcagaggctgctgccaatgggcatgtcccttacctgaaagggccacctctccaggtgacatgtcctgggggagccggggccgtctgctccggccagaggcgctcagctcaggccacaccaggcagggcacctcccaacctggacaggtggggaccaaggtggccttggacaaaactctctgtgtttgccaagcacccaatcggacacagagagtcaaccacaccccagtcacatggtgtccacacngcaggggtcaaggaggcccggcccctccccctcagacgtccctgggcctctgggagtcagcaaggacgaggacggcattgcccttcgagacaggaagggagtgacctcctcccggcggcatccaggctcngcttctccggagaggagagggggctacttgctggataaancggccggggccacagagaaaaagcaaggtgaccatgagcaccttgcaaacacagtgcacccaccagcatttnagcaccngggactgtgaagacctcccatttcttcggggggaaacncgcccaangttccccccaccntcactagtgnattgtgacctgggggncgggccgacccctgtngcttgggnnagccctccncccaggtttctnnggcngcccnttaanggnccctngnttggccccttggccncctttncgcttttccca

SEQ ID NO: 747 - DNA, 738 bp, Homo sapiens
  misc_feature (1)...(738): n=A,T,C or G
gatatcccgggaattcgcggccgcgtcnacgaagcacagacctgngccctgctctcatggggcagactgccatttgtcattnattactgaaggaaagggatcctcagtttgcttgtggacatttcaaatttgaggtgagagttggataagtaagaataaagctgctcttcaaagagatgaatatagaaaaagaaacaagatacagncttggcagtaaggctgggaggaaggggaaaaggtaataaagaatgaaagagtgagaaatgtgagcaggagctgaacacagaaaagttcagngacagaagcanaaggagggaagaagggaggagggtccctttcacagaggctcacgaggatgctttatgngtgccatgcagtccatgttcaggatgtctgcttcttanctctctacttttctaatanaaatttggatacttactgatcctacatatgtaacagggagagaaggtgaatttcaaagcantaaattgaaaaattgttcacaatttcattttttaaaaaaagggagctaacagaagaagaggttaatgtggtaattataggatgnctcttgcgacacatgaatgnatctggtatcatctgagtgggaggggagctgtcttcctgacccaaaaggatcctttcgttanccngnacttangtcccaaaacctcaccaccttggagaaatnatttccttttgggggtntcattaaanccttttggnccccgcaaaagc

SEQ ID NO: 748 - DNA, 647 bp, Homo sapiens
  misc_feature (1)...(647): n=A,T,C or G
ctntgtggcggtggctgtctcatttgggtggactttttgggtcgtaggaacctggtatngaggtcgagagtaagacgggctattagtagtcgcatcggagttatttgtgaaaacctggttagggcctctgtctccgctgcgctcgcctaaattggtatggctcgacttggaaacacggttctaacacgcgttgttagcgcccttgctagcatgtgaaggacactggccctaccaagaaagattcgagtcgctccttccggtatcgttcacggaggcgatatttactcttcttactacggttacttcgagattgtctgtgaagtttaagactactaaaaagagtattaagcctatcgggaattagctagatcgacacgctaaaaccaagggcaatcggcggaaatatagaggcaccaataatagggcctacagaaggcccgagggttagactcacgtttaataccggccacgggagaaataaaaagataaagtatacatcgtttagcggtcctcggaagccttcggctttaatgccaaggagtcggaagcatcgtcggcgagtaataaactccatcgcgccgagactatctacgacgccctccttaanatccgtaaattactcccggaaagagtatttaggcggctct

SEQ ID NO: 749 - DNA, 642 bp, Homo sapiens
  misc_feature (1)...(642): n=A,T,C or G
ctntgtggcggtggntgtctcatttgggtggactttttgggtcgtaggaacctggtatgcaggtccgcggagcgtgggctctcgtcgtggatgttgggggttggtgtggtgccggttgtttttggttctgttgagcgtagtgtgtttgaaggttagcgttcgtgtcttgcttgtggtttggtgtttagggcgggtggggaggttgttgtgtagctgttgtatgtcatattgttggtgttgctgccctgtgctgtttgtccttggttattgtggttgttaccccgcctgtgtggaagtgttgtggcagggcgggaatttaagtgggagagttgtgggacccgtggttgttgttacgttgctgcttttgtcgtgggcggtggcggcgcgtctgataattagaattggatacggagtgtataatacttctagtaaatggggacctagtgcttgacttcccggaatagggatctatgcgaagtccttaggatagtctttgataagtttaacgcccacgaccctaaaattatacacgattagacgcataacgactcctccaggaaagataaagaatctcacatatagaacgggaccccatacacgtcggataggaaacaagagaactaattttngttaaaaagactt

SEQ ID NO: 750 - DNA, 639 bp, Homo sapiens
  misc_feature (1)...(639): n=A,T,C or G
tttgtggcggtggtgtctcatttgggtggatttttgggtcgtaggtaacctggtatngaggtatagatgccgattggtcccgacgagcgtcacgataaattcggtagtttcgccctttttagaaggcgctagtactcggaacttcacttcatctcggtagtttactttggcgtatatagccttctccctcgaagactagccgtcacattcgttccctaggaatcgtttctgcccctaagaatccgagagcgagatcccgaaactagaggaaccttagaagagtcgtatttccacaaggaccccacagtcattccgggaaaatccctaggaccatacggttaggattcccccggaacccggagcaaagctcatgatttcccacaccgcgagagcgcctataaccctatcccatttcttcgggttatcgaggatattacgatcaagccgagagaaccgctagaaccgctttcttcgctttctcacggaacctataagtagaaagagaaactcaggtcttaagggggcgcttcggctaacgaaacttctacttacgaagagagtatctagacattaagtcataaaaatccactacgcacctcgtgtacgatatcatcgggagcggttcatagacggtgtccg

SEQ ID NO: 751 - DNA, 637 bp, Homo sapiens
  misc_feature (1)...(637): n=A,T,C or G
cttttgtggcggnggtgtctcatttgggtggatttttgggtcgtaggnaacctggtatngaggcagctctgagcccccccccccccccccccccccnccccccccccctaggnggttgggaanacggtggatacctaaatcgagtgngttcattaaaagtagttgattacnccctaaaataanaanagggcttcgtcggganaaatcggtaagganaagtctttntggcatcataanaatactggctcgggtcctaanatntttaaggnggtcnccgagggtnttcataccgataanaaacgttttcctatcggcaacgggcttacctgagggnggacttctcncggngcggngattnanacgaanacgtagaggattnccgntacttnttganatcacncgtatcatacttgtaagcataattntcctgaaaagtgttataanaatacgcncgcatattcgctttttcgtcctagggatgcttaaatggcgatactgctatagcgggtgagcgttggttctcgagnaanaaagcgtgtcctaatgcgtctaaggntttaaggncgttggtttaaaaatanccttagaaacctcgaggcggatactggtttntttttaacgaaacaaagcaccccnn

SEQ ID NO: 752 - DNA, 644 bp, Homo sapiens
  misc_feature (1)...(644): n=A,T,C or G
tntgtggcggtggtgctcatttgggtggatttttgggtcgtaggaacctggtatgaggtcttgcgagttgttggtgtgtcctgtcgttcggtggttcccttttgagttgagtttgtcctttgaggttgttagctgctgttcgtttgtgttcgtgtagtgctttgggttgagagggttatggtggtggttacggtgtattgtcgcccgtggtcgcggggttggggtggtcgtcggttttgtggttcatagtagtcttctgcgttcggtggtgcgggtttgggtgagtagtttcgttcttggatgtcccattgacccgccataatctaagtaagggttagtagaaacctctccccgatagacacaaccgtcgtccactaaagacctcgcctctgatttttaaaaggacccgaaaaacatcccttcaacggaaaaaacggaaaaaaagtcagcgaattcaaagaagccacgggagagaaaaaagaactaaagttagtccgtcattatatgtctcctcggaggaggaagcggcggtggcggaaaatgaggcggtaagaaagacgacctctatcggcggcttangccctaaaagggcgataccttacgggatgataaggaccctaggacgcctccttctcggatcgtcc

SEQ ID NO: 753 - DNA, 635 bp, Homo sapiens
  misc_feature (1)...(635): n=A,T,C or G
ctttgtggcggtggtgctcatttgggtggatttttgggtcgtaggaacctggtatgagggaatcagctcgacccccccccccccccccctccgaagcagagcccaacccaaagtccaccgactacccgagtaaactctcggagggtagaataagaaggagtaggtcctagccaatagaagtagttccgagccgttaggacagcggacggaacattnaagaaagagcctatattagggaggaagtaacgttcctctttcggagctctttaaggggtagtcccagaacaagggaagaggacccgtcggctattgcccgtcgatacgggctctcacggngagcctaggttcgaggatagggccgctcgtaaaattatacggtttccgagaaacgcttccgtagaccgggtcctaaatcgtccggagtattnggagagggatccttcggaccctagggacagagagaggagaacggaggttacaggaggagaacgtntcctcnctagttttctttangtcgaaaaatttcttaccgatagggttcctagggtcggngaatttacggttcgaaaaacggtagtncctaanggntgntattnggggtagtatcgggtcgtttacaantcgtccgtcttntg

SEQ ID NO: 754 - DNA, 721 bp, Homo sapiens
  misc_feature (1)...(721): n=A,T,C or G
accggattngttnctgagcgcgtgactgctaataaaaaagatggantgccatctttttttttnccttgctttatatatccagcagcaaaacaaaattgttctgcngggctataaaatttggcttgtgagtcntgtacacaactcaggagtgtgacacagctaccagctttcctcctaactctcaagggaagaaaattcaagttctgtctaggctcactctgtaaagtgggaaacttgctggttttgtaggctttttttccccttctttccctctctcagcttctccctgcttctcagaanatggagttgtgatgcctgcaacttaccaaatttatctatgaatcagattccagtgggagacccctaaagcagagggagaataaggagttctccccatgatggaaaatatccaaagacaaggtttcatggagcaaagaattctggctagatttggtttgtaagtggatccctccccactgcgtgtacactttatctgtctctttgcttcttccccaccctctttcccagctctctctctgtctctctcttgntcccctgacccttttttcttcccantgcatacttttttntttcccttttttaatcttctatantcttaancctaccaangggccctcntgannaatttntcacccctgaataggggattctntangccctgagaatttcnttatcanaaaaatatttttttaaagcatta

SEQ ID NO: 755 - DNA, 721 bp, Homo sapiens; identical to SEQ ID NO: 754
  misc_feature (1)...(721): n=A,T,C or G

SEQ ID NO: 756 - DNA, 873 bp, Homo sapiens
  misc_feature (1)...(873): n=A,T,C or G
ggaagaatacagtaagtttgcaaattaaaatttctctatttttctgttatttattcatttggaaactgtcagcctgtctctttcactttgggcaagtgaaagcaaagacgtccagtcctatcagcaattaggctgaaagtcaacgccaagctggcgggcaagggctggtctgagtagaggttccctaggcaggcaagagagagactcccactcgatactcccagctcggcaactgcctgaatgccaatgagcactcattataacccgccctattttataggatttaattttacacttcaggcttaatcagtctgaaagttaaactgacagtgttaagttacggaatcaatgacatttaggctttatgactttgtagctgaatatctatgggctatatttccattctaacagtgatatcctgttccagaatctcattctttggtgatggcactttctagtggagcagtcatggtaacagtccacacccattaccatgtgggtgctttacagcatactgacggaaggactgaggagccaccggagcaggagttcctctcagggaggacgctgacacttccacagctgcctangtatgggcacctgatgccaacgaanaacccaaagcgctctcccttccagatggaagctgccccacactgggctgacagcatctggagctgctctggctcaaatcccggaatcgcacanctcctancgggggcgtttanagatcctcngggccagctaccgaccacttttgacaagggncttaggagcgataactagnctggcgcgttacacncggatggaacgtcttggacttgagacctcttggggganatggcncccccaaataanttgggaaaantnggg

SEQ ID NO: 757 - DNA, 782 bp, Homo sapiens
  misc_feature (1)...(782): n=A,T,C or G
ggcccctcgagggatactctagagcggccgccgactagtgagctcgtcgacgatatcccgggatttgagaccaggagacagctccagatgctgtcagcccagtgctgggggcaggcttccatctgtgaagtggagaggcgctttgggcttcttcgttggcatcaggtgcccatacctagggcagctgtggaagtgtcagcgtcctccctgagaggaactcctgctccggtggctcctcagtccttccgtcagtatgctgtaaagcacccacatggtaatgggtgnggactggtaccatgactgntcccttaaaaggtggccttcccnaagaaaggagaattcttggacnagggatttcacttgnttagaaatgggaaaaattacccattagaattttcgnttccaaggcntnaagncctaaaaggcctttgattcccgaaccttaaccctgggcagttaacctttcaaacgggataaaccctganggggaaaatnaaatcctttaaaaaagggggggtttnaaggagggctctttggctttcaggcanttgccaacctgggaaattcanaggggaagtntttttttttgcctgcctagggaacctttacttaaacnaacccttgnccccccatttggggttgactttcancctaattgctgaaaggaccgggccgnttttgntttcctttgncccaaaggnaaanaaacgggtgccanttcccangggattanttcccgaaaatttggnnaatttttntttgnaactttttgggttttttcc

SEQ ID NO: 758 - DNA, 647 bp, Homo sapiens
  misc_feature (1)...(647): n=A,T,C or G
ntttgtggcggtggtgtctcatttgggtggactttttgggtcgtaggaacctggtatngagggaagagcgccgtcggtccgagtacagtatggagtagtatagtcttcgcgccttctcgggcggcggggctattctctccaaaggcagaggtccctagtcgacctcgctcccctaggttaggaacagccgtcgaatattttaggttcgtcgaggctttcttccgagctctacgcctaagtagctccgcgagcaaagtatcggtcattttcccctatccatcactcccctaagtacgcctcattattccggaaggcaagaggccagcattcctccttagagtagagggtaggtacctccgtcgcgtgccgcgaaagggcagagcttcgtgtcttccctccgcagcagcttaacggtctacgtaggcgttctcgatcttttcacgggaatcggggtccgggagggcggcggaaaacgtcgacgtctcggtcaccgtcaccgccccgaacaactagcggctttccgctttcaactgaggaaccccgcacccctcattagcgcttacgaaatcggggangtgattgcgccaattcgttagccttcgataattattctctattagcggtcctatctcgcgctttcgatttat

SEQ ID NO: 759 - DNA, 657 bp, Homo sapiens
  misc_feature (1)...(657): n=A,T,C or G
ctttgtggcggtggtgtctcatttgggtggactttttgggtcgtaggaacctggtatngagggctctatagaaagcctcttgtctttagatacgggctttctggtccttcgttctggaagtgtagtagtaggtactgcgggaaggcgaagagtcctttcaaggacgatttacttaagttggcttattctatagttccttcgggacataaggtcggtacgatctatactgcgtgggaagctgataggttgggacttaaggcgaataagaaggaggcggcggaggtcgcgattaccgcagagatattatttacggcggccgcgggtaccgcgggtcatgcggaaattttctgaggttcttggattcctaagatcgctcccgtcgagtatactagcgacgaacgtaagagtgccctcacaagaaccggtacaaactcaagaagaagttcccattaagcatcgtaagaaacggtaggacgaggacggtaagaagtaatcggagaaaggatcctagtngttacgaagaagcatcgttnagctactttgcgctaccgtttatatttagacgtgttccgtccttctccgtgtttanaaaaaaggtttattccgacgggagacttaggcgaatggagggttccgcggttganaatcggancgggg

SEQ ID NO: 760 - DNA, 644 bp, Homo sapiens
  misc_feature (1)...(644): n=A,T,C or G
ctttgtggcggtggtgtctcatttgggtggactttttgggtcgtaggaacctggtatgnaggaaaagaagtaagcctcgaagcctatctccgaccgtatttatttcgcagaagacggaactacggacgtcgttaaccccgagtagcccccgtaagaaaggactaaagcgaatggaaaagtcgggaattccggcggaggggcggcgattactgaaaggagtaagagtaagactattgcgatacttgaggcgttccctcttaaaaggcacccgaaacactctattaaaaaacacccgaagaagaacaactcatgcgatcggccgtgtgcagccgtcaatagtaaagagagccatgaaccatgccatccttagaccaattaggatgaagaagaggaggaagatgaggaccaaaccctacccactcggaaaaccccgcacgagcctccgaacaaaatccgggaattaaaacggcggcccacttccgcactctcgtagcgcggaccgaatagaaaaccggaaactacagctaaagggtcctttccggcctgttatctacccacccgcaatccgatcctccccccccctcgtccaaaaaccctaacctctgcggcaacattagagcagaaggagagggcgatcccttgan

SEQ ID NO: 761 - DNA, 647 bp, Homo sapiens
  misc_feature (1)...(647): n=A,T,C or G
ctttgtggcggtggtgtctcatttgggtggactttttgggtcgtaggaacctggtatngaggcgggtactctctgggataatcggtataagtgttgtaaaattgggggtaagagaaagtttcattataagaagtggaagcacgagccggggtgtttagtcgttaatattaagaccggtttttgttgtacttatatagcttgcgcgtggggaggcaataagaaacattgcgtttcgaggccggatgcggggaaccctcttcggggtctagagcgccgcatctgcaaaataaggactactgacgccgctcataacgtactcaacaatgagtcggcctgcattaagatttcggcgaagaaccgtactgcgtctactgatagtatattgcattgatagcggcatgagctttatcacgtgtcgttttcgggttgtaagaagggagttaagtcgatcttcgaggaagaagagaccccaaataaaaaatgactcaaaaaaacctagaagaaacacgacgaaaggaaaaagaacgttaaaactagtagctcttcggangagtagccttagtagggtaagtcctccgtgcgtactgtcctaaggtttggatagcgcggttgaatagacggtcacgcgtcagaaggtaaaaanccgg

SEQ ID NO: 762 - DNA, 628 bp, Homo sapiens
  misc_feature (1)...(628): n=A,T,C or G
cattgtgttggggtcactgagcccacttttttccagattttttgtaaaattgtttcgcattgtgttccctttattcgcttgtattaatatttgcgtagtggattaaacaaatacttggtgttgactgtcagtcttagaggactgactagaagtagttttcatttggggctcaggaaatacctactttatatttctagctaattaggaaagtcatttttcagttaggttggtgttttggttcaggcactcgctagctagatgacctaacatgctacttaatttctgagtgtttgtgtccatccctgtaggattgttgcggggttaaatgaaattgtgtatatttgtaaagcatttacctcagtgcccagactgtgacagagtagattattaggcttgctcttatttctgtgattaaatttagtgtcagattagcaacctatagctacttctaaagctgctgctgctttctttgtttagggttaggaagaaacatgctggacagtttgccaaatgagagttacatgatgtggcttgtgggaacattctaacttggaacttgcccatttccaggactttgnggttcanagatttttggggatagatgtaagggttaaaaaaaacngaaaac

SEQ ID NO: 763 - DNA, 147 bp, Homo sapiens
  misc_feature (1)...(147): n=A,T,C or G
cattgtgttggggcagagataaataattcctctgaaaagtgttttattggaatttcaaatgaaaagctaactggataacttacagcatgtttctgccaataatctcttanaacaggcctcttttttttatgcacaccaccttcnggc

SEQ ID NO: 764 - DNA, 146 bp, Homo sapiens
  misc_feature (1)...(146): n=A,T,C or G
cattgtgttgggtatgttttttgaaggcaggtggacaggatttgctgatgggtaaatggcagagttagggggactgttagaacagagaaaganatcatggggttgggtttgagtctgatgnnnaactggtgccgnntgctcagtat

SEQ ID NO: 765 - DNA, 129 bp, Homo sapiens
  misc_feature (1)...(129): n=A,T,C or G
tncncgattcgntnctagcgtntacactnatgtcttggtaccgagctcggatccactagtccagtgtgggnggaattccattgtgttggggcaggaggngctttgngtacngtgcggctgnagaggcgg

SEQ ID NO: 766 - DNA, 175 bp, Homo sapiens
  misc_feature (1)...(175): n=A,T,C or G
cattgtgttgggcctagtccgaatacttttagtaacttcagacagatctcctcatctctttctggggcttggnttttctcctttgtanaatgatgcctttctgtggttttgtcatttctaacattctgtgngtgatgaggtgtatattcganganctctatcnccanagtactct

SEQ ID NO: 767 - DNA, 602 bp, Homo sapiens
  misc_feature (1)...(602): n=A,T,C or G
nnntttaaaanctgtnctccccgcggtggcggccgctctagaactagtggatcctttccacctggtttgttttcagtgtttaatcctattagtatcagcaggatataggtcaggatatcaggtgcagaacctgtggaatcagccaatttggcttgctcatttactttaataaggtcccataatgagtgagagtacaaagttcaagccctgttgagggtctgcattaaactctcagaagtatttagagtgtgccaggagccgcgaaggtctggttcgggtggtggcgggaactgtattagagtgctaggcacggcgcgacaaagtctgtccaacccaaaacggtgctgaggcgttgggtgtgagctccagtactcagaaaagcatctcagcaggtactcaacagatcctcaggggcttgggggcccagcactggcagtgagggcatgaaagacataaaagggcactacctgtgggtattttctgttctccaaggaggaagtagcaaaaattaggacgctggaatatcctatgttgtagcaatcccagaacaactgatgctcaacaaataccacacaaaacaaattttttaaaatttaatctta

SEQ ID NO: 768 - DNA, 671 bp, Homo sapiens
  misc_feature (1)...(671): n=A,T,C or G
tccaccgcggtggcggccgctctagactagtggatccactagtccagtgtgggtgggaattcgcggcncgcgtcgacaaaaatactgctaaagtaatatttttatagatgactatttgccttggggccaggaaaagcagctggagttattcacttagtaccatttttacatactaactttgccttttccatgcttgcttgatgcggcttgcagcactgaagaacagtttcaattgctagccaaccagagagcatgatcaaaccaaacaagttccctgtttcaggaaaaacaggttttaggtaactgaagggttaccagttactgattccacaatcttctctgtaaaanatttctgcctattatgcagactgggcggctttaaanntggtaaaactatnaaatacccatacaatattttaanggggccccnttatnaagcttttcaggccttcccctttccatagcattggtgggatacaagaaacctttaaacagcaacnagctatcnaggcccaaaaggaaagtaattntgattttttanagattccgnaacgaaaaaatggctgggttcaaatacnaccttctttttaaaatggnttccttattaaacnttttttttttttaattttaccccatggtcntgatnttngngcttccgcccanaaaatngn

SEQ ID NO: 769 - DNA, 877 bp, Homo sapiens
  misc_feature (1)...(877): n=A,T,C or G
aaagctggagctccccgcggtggcggccgctctagaactagtggatccactagtccanngngggggaattcgcggccgcgtcgacctctatacctttgntcatgcagcttcctctgactgggtttgttcttcacttggctaacccctcttttacttaagcacaccttgaacattccctccttccccatttccccgcagngcccctaatggacatacttctgaataacacaggtggtattccttccttgttggaacctcctggaggaagagacagatgattaacaaatccttccatcaacccctttgaccatgacatcaacagtgctccaaattatggggtaccgtattagcctatgtctatcttgatcagaatccttacctcggtgtattgaaattatctatttcgtgcctgcctctttaaagtcagggtttgccttatctattgtctaacaccatgcagtaggtaacatgcagtaggaaacatggcattaaattatttgggttcaaatcccagttatggtgtgtaaatgcctaccaggccgtgaggcacctgctaagcaggttgcacgcatcatttgaattcacaccacccttttgcaatagaacagataggcaacagaggctcatttgggctaaaggatttgatggaggggaagtgccaggattcccaccaaggcctcanggcccaggtccanggaccatgtctgttgtgacaactggagtgcatttcatatcccctnctctgnggggnaaggtccctcncgnggagaacnnttaaaacaatcatntctngggggnttaatgcttcttnccccagtgtggtncactgcngccacgagtcccanccactagtcccangtctgtcatgaaccanccc

SEQ ID NO: 770 - DNA, 874 bp, Homo sapiens
  misc_feature (1)...(874): n=A,T,C or G
ctggnctccccgcggtggcggccgctctagaactagtggatccactagtccagtgtggtggaattcgcggccgcgtcgaccttttcaaaggttaacttatttaattatcacannngcaacccgatgagtaggtaacagtattttactgataggtaatctaaagaaggaggctaaataaattgcccaatttcgaacagtgagaggaagaattaggattgaaacacatatagtggcttcagaatctgtaaccctcacgatgccactactacttctttcagaataccctttgcctatctattctgttcctatgtcatcaaattatacttactttaaaaagtatttgtctttattatttttaaaaaaacacagggaagtatttctgatcaggggcagtattggttctgaaagacaagccagtgtttttgagggtttctcccttgccagtttttctatgctgggttattcaagtcctaagaattgtgtagctattacagaaccgctttagcaaatgtgttccattaatcaaggtgatttataacaaaatttcatccaagtttggagtgctctgaaaacatagccaaaatgttcgcagggtctacccctctcgtgtgtcccttttttttagctatttcagaagcacactggtgcaatattttacgaaatgagtttcttccccttacctctgcatcctctaagaaaaaatcattgntgttttatgaanatgaanatcctgctatttcatatcttgattggagctgcttaattaaatgaccattttnaaatttgttttgattccnngcaaaaaaagtttnttnttggatgtagggggctcnnaaagnccaaaaccccccaaaatttttnnttgggaacccna

SEQ ID NO: 771 - DNA, 156 bp, Homo sapiens
  misc_feature (1)...(156): n=A,T,C or G
ttaaaaanctggnctccccgcggtggcggccgctctagaactagtggatccactagtccagtgtggtggaattcgcggccgcgtcgaccgcgagcggtcgcccttttttttttttttttnngtttttttgaanaattcattgggtatttattattc

SEQ ID NO: 772 - DNA, 586 bp, Homo sapiens
  misc_feature (1)...(586): n=A,T,C or G
ncaanctggnctccaccgcggtggcggccgctctagactagtggatccactagtccagtgtggtggaattcgcggccgcgtcgatcacaaagtgctcacaagtccngnatttattttatctccagatatgaaacttacccccagctatggtcttctatttgttatttaatttctaggccaattttttccacttgaatgtcagtattttaattcaaagtcaccttgtccaaataccaagtcatcaacttaccctcaaattatatcctcattcagaaaatctacatctattaatggtagctattttatccctgccccctgctttttctttttatatttaattaatttgntcatccagcaaatgcttattgagcaggtattgtaggctaaacaattctanactttaaggggacacagnttgcaaaacaaaatcctgccttgnatggatacttatgnnatggngggatacagacaatcaacataatgangngcatcatatataatggttagnanaatgataagggnttttgggaaaaaaatgcacccanccaananggattgggaagtgganggganggtcangggangg

SEQ ID NO: 773 - DNA, 2983 bp, Homo sapiens
agagatagagtcttccctggcattgcaggagagaatctgaagggatgatggatgcatcaaaagagctgcaagttctccacattgacttcttgaatcaggacaacgccgtttctcaccacacatgggagttccaaacgagcagtcctgtgttccggcgaggacaggtgtttcacctgcggctggtgctgaaccagcccctacaatcctaccaccaactgaaactggaattcagcacagggccgaatcctagcatcgccaaacacaccctggtggtgctcgacccgaggacgccctcagaccactacaactggcaggcaacccttcaaaatgagtctggcaaagaggtcacagtggctgtcaccagttcccccaatgccatcctgggcaagtaccaactaaacgtgaaaactggaaaccacatccttaagtctgaagaaaacatcctataccttctcttcaacccatggtgtaaagaggacatggttttcatgcctgatgaggacgagcgcaaagagtacatcctcaatgacacgggctgccattacgtgggggctgccagaagtatcaaatgcaaaccctggaactttggtcagtttgagaaaaatgtcctggactgctgcatttccctgctgactgagagctccctcaagcccacagataggagggaccccgtgctggtgtgcagggccatgtgtgctatgatgagctttgagaaaggccagggcgtgctcattgggaattggactggggactatgaaggtggcacagccccatacaagtggacaggcagtgccccgatcctgcagcagtactacaacacgaagcaggctgtgtgctttggccagtgctgggtgtttgctgggatcctgactacagtgctgagagcgttgggcatcccagcacgcagtgtgacaggcttcgattcagctcacgacacagaaaggaacctcacggtggacacctatgtgaatgagaatggcaagaaaatcaccagtatgacccacgactctgtctggaatttccatgtgtggacggatgcctggatgaagcgaccggatctgcccaagggctacgacggctggcaggctgtggacgcaacgccgcaggagcgaagccagggtgtcttctgctgtgggccatcaccactgaccgccatccgcaaaggtgacatctttattgtctatgacaccagattcgtcttctcagaagtgaatggtgacaggctcatctggttggtgaagatggtgaatgggcaggaggagttacacgtaatttcaatggagaccacaagcatcgggaaaaacatcagcaccaaggcagtgggccaagacaggcggagagatatcacctatgagtacaagtatccagaaggctcctctgaggagaggcaggtcatggatcatgccttcctccttctcagttctgagagggagcacagacgacctgtaaaagagaactttcttcacatgtcggtacaatcagatgatgtgctgctgggaaactctgttaatttcaccgtgattcttaaaaggaagaccgctgccctacagaatgtcaacatcttgggctcctttgaactacagttgtacactggcaagaagatggcaaaactgtgtgacctcaataagacctcgcagatccaaggtcaagtatcagaagtgactctgaccttggactccaagacctacatcaacagcctggctatattagatgatgagccagttatcagaggtttcatcattgcggaaattgtggagtctaaggaaatcatggcctctgaagtattcacgtctttccagtaccctgagttctctatagagttgcctaacacaggcagaattggccagctacttgtctgcaattgtatcttcaagaataccctggccatccctttgactgacgtcaagttctctttggaaagcctgggcatctcctcactacagacctctgaccatgggacggtgcagcctggtgagaccatccaatcccaaataaaatgcaccccaataaaaactggacccaagaaatttatcgtcaagttaagttccaaacaagtgaaagagattaatgctcagaagattgttctcatcaccaagtagccttgtctgatgctgtggagccttagttgagatttcagcatttcctaccttgtgcttagctttcagattatggatgattaaatttgatgacttatatgagggcagattcaagagccagcaggtcaaaaaggccaacacaaccataagcagccagacccacaaggccaggtcctgtgctatcacagggtcacctcttttacagttagaaacaccagccgaggccacagaatcccatccctttcctgagtcatggcctcaaaaatcagggccaccattgtctcaattcaaatccatagatttcgaagccacagagtctctccctggagcagcagactatgggcagcccagtgctgccacctgctgacgacccttgagaagctgccatatcttcaggccatgggttcaccagccctgaaggcacctgtcaactggagtgctctctcagcactgggatgggcctgatagaagtgcattctcctcctattgcctccattctcctctctctatccctgaaatccaggaagtccctctcctggtgctccaagcagtttgaagcccaatctgcaaggacatttctcaagggccatgtggttttgcagacaaccctgtcctcaggcctgaactcaccatagagacccatgtcagcaaacggtgaccagcaaatcctcttcccttattctaaagctgccccttgggagactccagggagaaggcattgcttcctccctggtgtgaactctttctttggtattccatccactatcctggcaactcaaggctgcttctgttaactgaagcctgctccttcttgttctgccctccagagatttgctcaaatgatcaataagctttaaattaaactctacttcaagaaaaaaaaaccg

SEQ ID NO: 774 - DNA, 3064 bp, Homo sapiens
aattctaaaaatgcttttgcaagcttgcatgcctgcaggtgcagcggccgccagtgtgatggatatctgcagaattcggcttgcgctcagctggaattccgcagagatagagtcttccctggcattgcaggagagaatctgaagggatgatggatgcatcaaaagagctgcaagttctccacattgacttcttgaatcaggacaacgccgtttctcaccacacatgggagttccaaacgagcagtcctgtgttccggcgaggacaggtgtttcacctgcggctggtgctgaaccagcccctacaatcctaccaccaactgaaactggaattcagcacagggccgaatcctagcatcgccaaacacaccctggtggtgctcgacccgaggacgccctcagaccactacaactggcaggcaacccttcaaaatgagtctggcaaagaggtcacagtggctgtcaccagttcccccaatgccatcctgggcaagtaccaactaaacgtgaaaactggaaaccacatccttaagtctgaagaaaacatcctataccttctcttcaacccatggtgtaaagaggacatggttttcatgcctgatgaggacgagcgcaaagagtacatcctcaatgacacgggctgccattacgtgggggctgccagaagtatcaaatgcaaaccctggaactttggtcagtttgagaaaaatgtcctggactgctgcatttccctgctgactgagagctccctcaagcccacagataggagggaccccgtgctggtgtgcagggccatgtgtgctatgatgagctttgagaaaggccagggcgtgctcattgggaattggactggggactacgaaggtggcacagccccatacaagtggacaggcagtgccccgatcctgcagcagtactacaacacgaagcaggctgtgtgctttggccagtgctgggtgtttgctgggatcctgactacagtgctgagagcgttgggcatcccagcacgcagtgtgacaggcttcgattcagctcacgacacagaaaggaacctcacggtggacacctatgtgaatgagaatggcgagaaaatcaccagtatgacccacgactctgtctggaatttccatgtgtggacggatgcctggatgaagcgaccctacgacggctggcaggctgtggacgcaacgccgcaggagcgaagccagggtgtcttctgctgtgggccatcaccactgaccgccatccgcaaaggtgacatctttattgtctatgacaccagattcgtcttctcagaagtgaatggtgacaggctcatctggttggtgaagatggtgaatgggcaggaggagttacacgtaatttcaatggagaccacaagcatcgggaaaaacatcagcaccaaggcagtgggccaagacaggcggagagatatcacctatgagtacaagtatccagaaggctcctctgaggagaggcaggtcatggatcatgccttcctccttctcagttctgagagggagcacagacagcctgtaaaagagaactttcttcacatgtcggtacaatcagatgatgtgctgctgggaaactctgttaatttcaccgtgattcttaaaaggaagaccgctgccctacagaatgtcaacatcttgggctcctttgaactacagttgtacactggcaagaagatggcaaaactgtgtgacctcaataagacctcgcagatccaaggtcaagtatcagaagtgactctgaccttggactccaagacctacatcaacagcctggctatattagatgatgagccagttatcagaggtttcatcattgcggaaattgtggagtctaaggaaatcatggcctctgaagtattcacgtcaaaccagtaccctgagttctctatagagttgcctaacacaggcagaattggccagctacttgtctgcaattgtatcttcaagaataccctggccatccctttgactgacgtcaagttctctttggaaagcctgggcatctcctcactacagacctctgaccatgggacggtgcagcctggtgagaccatccaatcccaaataaaatgcaccccaataaaaactggacccaagaaatttatcgtcaagttaagttccaaacaagtgaaagagattaatgctcagaagattgttctcatcaccaagtagccttgtctgatgctgtggagccttagttgagatttcagcatttcctaccttgtgcttagctttcagattatggatgattaaatttgatgacttatatgagggcagattcaagagccagcaggtcaaaaaggccaacacaaccataagcagccagacccacaaggccaggtcctgtgctatcacagggtcacctcttttacagttagaaacaccagccgaggccacagaatcccatccctttcctgagtcatggcctcaaaaatcagggccaccattgtctcaattcaaatccatagatttcgaagccacagagctcttccctggagcagcagactatgggcagcccagtgctgccacctgctgacgacccttgagaagctgccatatcttcaggccatgggttcaccagccctgaaggcacctgtcaactggagtgctctctcagcactgggatgggcctgatagaagtgcattctcctcctattgcctccattctcctctctctatccctgaaatccaggaagtccctctcctggtgctccaagcagtttgaagcccaatctgcaaggacatttctcaagggccatgtggttttgcagacaaccctgtcctcaggcctgaactcaccatagagacccatgtcagcaaacggtgaccagcaaatcctcttcccttattctaaagctgccccttgggagactccagggagaaggcattgcttcctccctggtgtgaactctttctttggtattccatccactatcctggcaactcaaggctgcttctgttaactgaagcctgctccttcttgttctgccctccagagatttgctcaaatgatcaataagctttaaattaaaccggaatccgcggaattc

SEQ ID NO: 775 - protein, 684 aa, Homo sapiens
MMDASKELQVLHIDFLNQDNAVSHHTWEFQTSSPVFRRGQVFHLRLVLNQPLQSYHQLKLEFSTGPNPSIAKHTLVVLDPRTPSDHYNWQATLQNESGKEVTVAVTSSPNAILGKYQLNVKTGNHILKSEENILYLLFNPWCKEDMVFMPDEDERKEYILNDTGCHYVGAARSIKCKPWNFGQFEKNVLDCCISLLTESSLKPTDRRDPVLVCRAMCAMMSFEKGQGVLIGNWTGDYEGGTAPYKWTGSAPILQQYYNTKQAVCFGQCWVFAGILTTVLRALGIPARSVTGFDSAHDTERNLTVDTYVNENGKKITSMTHDSVWNFHVWTDAWMKRPDLPKGYDGWQAVDATPQERSQGVFCCGPSPLTAIRKGDIFIVYDTRFVFSEVNGDRLIWLVKMVNGQEELHVISMETTSIGKNISTKAVGQDRRRDITYEYKYPEGSSEERQVMDHAFLLLSSEREHRRPVKENFLHMSVQSDDVLLGNSVNFTVILKRKTAALQNVNILGSFELQLYTGKKMAKLCDLNKTSQIQGQVSEVTLTLDSKTYINSLAILDDEPVIRGFIIAEIVESKEIMASEVFTSFQYPEFSIELPNTGRIGQLLVCNCIFKNTLAIPLTDVKFSLESLGISSLQTSDHGTVQPGETIQSQIKCTPIKTGPKKFIVKLSSKQVKEINAQKIVLITK

SEQ ID NO: 776 - protein, 679 aa, Homo sapiens
MMDASKELQVLHIDFLNQDNAVSHHTWEFQTSSPVFRRGQVFHLRLVLNQPLQSYHQLKLEFSTGPNPSIAKHTLVVLDPRTPSDHYNWQATLQNESGKEVTVAVTSSPNAILGKYQLNVKTGNHILKSEENILYLLFNPWCKEDMVFMPDEDERKEYILNDTGCHYVGAARSIKCKPWNFGQFEKNVLDCCISLLTESSLKPTDRRDPVLVCRAMCAMMSFEKGQGVLIGNWTGDYEGGTAPYKWTGSAPILQQYYNTKQAVCFGQCWVFAGILTTVLRALGIPARSVTGFDSAHDTERNLTVDTYVNENGEKITSMTHDSVWNFHVWTDAWMKRPYDGWQAVDATPQERSQGVFCCGPSPLTAIRKGDIFIVYDTRFVFSEVNGDRLIWLVKMVNGQEELHVISMETTSIGKNISTKAVGQDRRRDITYEYKYPEGSSEERQVMDHAFLLLSSEREHRQPVKENFLHMSVQSDDVLLGNSVNFTVILKRKTAALQNVNILGSFELQLYTGKKMAKLCDLNKTSQIQGQVSEVTLTLDSKTYINSLAILDDEPVIRGFIIAEIVESKEIMASEVFTSNQYPEFSIELPNTGRIGQLLVCNCIFKNTLAIPLTDVKFSLESLGISSLQTSDHGTVQPGETIQSQIKCTPIKTGPKKFIVKLSSKQVKEINAQKIVLITK

SEQ ID NO: 777 - DNA, 5668 bp, Homo sapiens
gtcacttaggaaaaggtgtcctttcgggcagccgggctcagcatgaggaacagaaggaatgacactctggacagcacccggaccctgtactccagcgcgtctcggagcacagacttgtcttacagtgaaagcgacttggtgaattttattcaagcaaattttaagaaacgagaatgtgtcttctttaccaaagattccaaggccacggagaatgtgtgcaagtgtggctatgcccagagccagcacatggaaggcacccagatcaaccaaagtgagaaatggaactacaagaaacacaccaaggaatttcctaccgacgcctttggggatattcagtttgagacactggggaagaaagggaagtatatacgtctgtcctgcgacacggacgcggaaatcctttacgagctgctgacccagcactggcacctgaaaacacccaacctggtcatttctgtgaccgggggcgccaagaacttcgccctgaagccgcgcatgcgcaagatcttcagccggctcatctacatcgcgcagtccaaaggtgcttggattctcacgggaggcacccattatggcctgacgaagtacatcggggaggtggtgagagataacaccatcagcaggagttcagaggagaatattgtggccattggcatagcagcttggggcatggtctccaaccgggacaccctcatcaggaattgcgatgctgagggctattttttagcccagtaccttatggatgacttcacaagggatccactgtatatcctggacaacaaccacacacatttgctgctcgtggacaatggctgtcatggacatcccactgtcgaagcaaagctccggaatcagctagagaagcatatctctgagcgcactattcaagattccaactatggtggcaagatccccattgtgtgttttgcccaaggaggtggaaaagagactttgaaagccatcaatacctccatcaaaaataaaattccttgtgtggtggtggaaggctcgggccggatcgctgatgtgatcgctagcctggtggaggtggaggatgccccgacatcttctgccgtcaaggagaagctggtgcgctttttaccccgcacggtgtcccggctgtctgaggaggagactgagagttggatcaaatggctcaaagaaattctcgaatgttctcacctattaacagttattaaaatggaagaagctggggatgaaattgtgagcaatgccatctcctacgctctatacaaagccttcagcaccagtgagcaagacaaggataactggaatgggcagctgaagcttctgctggagtggaaccagctggacttagccaatgatgagattttcaccaatgaccgccgatgggagtctgctgaccttcaagaagtcatgtttacggctctcataaaggacagacccaagtttgtccgcctctttctggagaatggcttgaacctacggaagtttctcacccatgatgtcctcactgaactcttctccaaccacttcagcacgcttgtgtaccggaatctgcagatcgccaagaattcctataatgatgccctcctcacgtttgtctggaaactggttgcgaacttccgaagaggcttccggaaggaagacagaaatggccgggacgagatggacatagaactccacgacgtgtctcctattactcggcaccccctgcaagctctcttcatctgggccattcttcagaataagaaggaactctccaaagtcatttgggagcagaccaggggctgcactctggcagccctgggagccagcaagcttctgaagactctggccaaagtgaagaacgacatcaatgctgctggggagtccgaggagctggctaatgagtacgagacccgggctgttgagctgttcactgagtgttacagcagcgatgaagacttggcagaacagctgctggtctattcctgtgaagcttggggtggaagcaactgtctggagctggcggtggaggccacagaccagcatttcaccgcccagcctggggtccagaattttctttctaagcaatggtatggagagatttcccgagacaccaagaactggaagattatcctgtgtctgtttattatacccttggtgggctgtggctttgtatcatttaggaagaaacctgtcgacaagcacaagaagctgctttggtactatgtggcgttcttcacctcccccttcgtggtcttctcctggaatgtggtcttctacatcgccttcctcctgctgtttgcctacgtgctgctcatggatttccattcggtgccacacccccccgagctggtcctgtactcgctggtctttgtcctcttctgtgatgaagtgagacagtggtacgtaaatggggtgaattattttactgacctgtggaatgtgatggacacgctggggcttttttacttcatagcaggaattgtatttcggctccactcttctaataaaagctctttgtattctggacgagtcattttctgtctggactacattattttcactctaagattgatccacatttttactgtaagcagaaacttaggacccaagattataatgctgcagaggatgctgatcgatgtgttcttcttcctgttcctctttgcggtgtggatggtggcctttggcgtggccaggcaagggatccttaggcagaatgagcagcgctggaggtggatattccgttcggtcatctacgagccctacctggccatgttcggccaggtgcccagtgacgtggatggtaccacgtatgactttgcccactgcaccttcactgggaatgagtccaagccactgtgtgtggagctggatgagcacaacctgccccggttccccgagtggatcaccatccccctggtgtgcatctacatgttatccaccaacatcctgctggtcaacctgctggtcgccatgtttggctacacggtgggcaccgtccaggagaacaatgaccaggtctggaagttccagaggtacttcctggtgcaggagtactgcagccgcctcaatatccccttccccttcatcgtcttcgcttacttctacatggtggtgaagaagtgcttcaagtgttgctgcaaggagaaaaacatggagtcttctgtctgctgtttcaaaaatgaagacaatgagactctggcatgggagggtgtcatgaaggaaaactaccttgtcaagatcaacacaaaagccaacgacacctcagaggaaatgaggcatcgatttagacaactggatacaaagcttaatgatctcaagggtcttctgaaagagattgctaataaaatcaaataaaactgtatgaaactctaatggagaaaaatctaattatagcaagatcatattaaggaatgctgatgaacaattttgctatcgactactaaatgagagattttcagacccctgggtacatggtggatgattttaaatcaccctagtgtgctgagaccttgagaataaagtgtgtgattggtttcatacttgaagacggatataaaggaagaatatttcctttatgtgtttctccagaatggtgcctgtttctctctgtgtctcaatgcctgggactggaggttgatagtttaagtgtgttcttaccgcctcctttttcctttaatcttatttttgatgaacacatatataggagaacatctatcctatgaataagaacctggtcatgctttactcctgtattgttattttgttcatttccaattgattctctacttttcccttttttgtattatgtgactaattagttggcatattgttaaaagtctctcaaattaggccagattctaaaacatgctgcagcaagaggaccccgctctcttcaggaaaagtgttttcatttctcaggatgcttcttacctgtcagaggaggtgacaaggcagtctcttgctctcttggactcaccaggctcctattgaaggaaccacccccattcctaaatatgtgaaaagtcgcccaaaatgcaaccttgaaaggcactactgactttgttcttattggatactcctcttatttattatttttccattaaaaataatagctggctattatagaaaatttagaccatacagagatgtagaaagaacataaattgtccccattaccttaaggtaatcactgctaacaatttctggatggtttttcaagtctattttttttctatgtatgtctcaattctctttcaaaattttacagaatgttatcatactacatatatactttttatgtaagctttttcacttagtattttatcaaatatgtttttattatattcatagccttcttaaacattatatcaataattgcataataggcaacctctagcgattaccataattttgctcattgaaggctatctccagttgatcattgggatgagcatctttgtgcatgaatcctattgctgtatttgggaaaattttccaaggttagattccaataaatatctatttattattaaatattaaaatatcgatttattattaaaaccatttataaggctttttcataaatgtatagcaaataggaattattaacttgagcataagatatgagatacatgaacctgaactattaaaataaaatattatatttaaccctagtttaagaagaagtcaatatgcttatttaaatattatggatggtgggcagatcacttgaggtcaggagttcgagaccagcctggccaacatggcaaaaccacatctctactaaaaataaaaaaattagctgggtgtggtggtgcactcctgtaatcccagctactcagaaggctgaggtacaagaattgctggaacctgggaggcggaggttgcagtgaaccaagattgcaccactgcactccagccggggtgacagagtgagactccgactgaaaataaataaataaataaataaataaataaataaataaatattatggatggtgaagggaatggtatagaattggagagattatcttactgaacacctgtagtcccagctttctctggaagtggtggtatttgagcaggatgtgcacaaggcaattgaaatgcccataattagtttctcagctttgaatacactataaactcagtggctgaaggaggaaattttagaaggaagctactaaaagatctaatttgaaaaactacaaaagcattaactaaaaaagtttattttccttttgtctgggcagtagtgaaaataactactcacaacattcactatgtttgcaaggaattaacacaaataaaagatgcctttttacttaaacgccaagacagaaaacttgcccaatactgagaagcaacttgcattagagagggaactgttaaatgttttcaacccagttcatctggtggatgtttttgcaggttactctgagaattttgcttatgaaaaatcattatttttagtgtagttcacaataatgtattgaacatacttctaatcaaaggtgctatgtccttgtgtatggtactaaatgtgtcctgtgtacttttgcacaactgagaatcctgcggcttggtttaatgagtgtgttcatgaaataaataatggaggaattgtcaaaaaaaaaaaaaaaaaaaaaaaaaaaaaaaaaaaaaaaaaaaaaaaaaaaaaaaaaaaaaaaaa

SEQ ID NO: 778 - protein, 1095 aa, Homo sapiens
MRNRRNDTLDSTRTLYSSASRSTDLSYSESDLVNFIQANFKKRECVFFTKDSKATENVCKCGYAQSQHMEGTQINQSEKWNYKKHTKEFPTDAFGDIQFETLGKKGKYIRLSCDTDAEILYELLTQHWHLKTPNLVISVTGGAKNFALKPRMRKIFSRLIYIAQSKGAWILTGGTHYGLTKYIGEVVRDNTISRSSEENIVAIGIAAWGMVSNRDTLIRNCDAEGYFLAQYLMDDFTRDPLYILDNNHTHLLLVDNGCHGHPTVEAKLRNQLEKHISERTIQDSNYGGKIPIVCFAQGGGKETLKAINTSIKNKIPCVVVEGSGRIADVIASLVEVEDAPTSSAVKEKLVRFLPRTVSRLSEEETESWIKWLKEILECSHLLTVIKMEEAGDEIVSNAISYALYKAFSTSEQDKDNWNGQLKLLLEWNQLDLANDEIFTNDRRWESADLQEVMFTALIKDRPKFVRLFLENGLNLRKFLTHDVLTELFSNHFSTLVYRNLQIAKNSYNDALLTFVWKLVANFRRGFRKEDRNGRDEMDIELHDVSPITRHPLQALFIWAILQNKKELSKVIWEQTRGCTLAALGASKLLKTLAKVKNDINAAGESEELANEYETRAVELFTECYSSDEDLAEQLLVYSCEAWGGSNCLELAVEATDQHFTAQPGVQNFLSKQWYGEISRDTKNWKIILCLFIIPLVGCGFVSFRKKPVDKHKKLLWYYVAFFTSPFVVFSWNVVFYIAFLLLFAYVLLMDFHSVPHPPELVLYSLVFVLFCDEVRQWYVNGVNYFTDLWNVMDTLGLFYFIAGIVFRLHSSNKSSLYSGRVIFCLDYIIFTLRLIHIFTVSRNLGPKIIMLQRMLIDVFFFLFLFAVWMVAFGVARQGILRQNEQRWRWIFRSVIYEPYLAMFGQVPSDVDGTTYDFAHCTFTGNESKPLCVELDEHNLPRFPEWITIPLVCIYMLSTNILLVNLLVAMFGYTVGTVQENNDQVWKFQRYFLVQEYCSRLNIPFPFIVFAYFYMVVKKCFKCCCKEKNMESSVCCFKNEDNETLAWEGVMKENYLVKINTKANDTSEEMRHRFRQLDTKLNDLKGLLKEIANKIK

SEQ ID NO: 779 - DNA, 3639 bp, Homo sapiens
gattacgcaagctatttaggtgacactatagaatwctcagcttgcatcaagcttggtaccgagctcggatccctagtaacggccgccagtgtgctggaattcgcccttgcagccgggctcagcatgaggaacagaaggaatgacactctggacagcacccggaccctgtactccagcgcgtctcggagcacagacttgtcttacagtgaaagcgacttggtgaattttattcaagcaaattttaagaaacgagaatgtgtcttctttaccaaagattccaaggccacggagaatgtgtgcaagtgtggctatgcccagagccagcacatggaaggcacccagatcaaccaaagtgagaaatggaactacaagaaacacaccaaggaatttcctaccgacgcctttggggatattcagtttgagacactggggaagaaagggaagtatatacgtctgtcctgcgacacggacgcggaaatcctttacgagctgctgacccagcactggcacctgaaaacacccaacctggtcatttctgtgaccgggggcgccaagaacttcgccctgaagccgcgcatgcgcaagatcttcagccggctcatctacatcgcgcagtccaaaggtgcttggattctcacgggaggcacccattatggcctgatgaagtacatcggggaggtggtgagagataacaccatcagcaggagttcagaggagaatattgtggccattggcatagcagcttggggcatggtctccaaccgggacaccctcatcaggaattgcgatgctgagggctattttttagcccagtaccttatggatgacttcacaagagatccactgtatatcctggacaacaaccacacacatttgctgctcgtggacaatggctgtcatggacatcccactgtcgaagcaaagctccggaatcagctagagaagtatatctctgagcgcactattcaagattccaactatggtggcaagatccccattgtgtgttttgcccaaggaggtggaaaagagactttgaaagccatcaatacctccatcaaaaataaaattccttgtgtggtggtggaaggctcgggccagatcgctgatgtgatcgctagcctggtggaggtggaggatgccctgacatcttctgccgtcaaggagaagctggtgcgctttttaccccgcacggtgtcccggctgcctgaggaggagactgagagttggatcaaatggctcaaagaaattctcgaatgttctcacctattaacagttattaaaatggaagaagctggggatgaaattgtgagcaatgccatctcctacgctctatacaaagccttcagcaccagtgagcaagacaaggataactggaatgggcagctgaagcttctgctggagtggaaccagctggacttagccaatgatgagattttcaccaatgaccgccgatgggagtctgctgaccttcaagaagtcatgtttacggctctcataaaggacagacccaagtttgtccgcctctttctggagaatggcttgaacctacggaagtttctcacccatgatgtcctcactgaactcttctccaaccacttcagcacgcttgtgtaccggaatctgcagatcgccaagaattcctataatgatgccctcctcacgtttgtctggaaactggttgcgaacttccgaagaggcttccggaaggaagacagaaatggccgggacgagatggacatagaactccacgacgtgtctcctattactcggcaccccctgcaagctctcttcatctgggccattcttcagaataagaaggaactctccaaagtcatttgggagcagaccaggggctgcactctggcagccctgggagccagcaagcttctgaagactctggccaaagtgaagaacgacatcaatgctgctggggagtccgaggagctggctaatgagtacgagacccgggctgttgagctgttcactgagtgttacagcagcgatgaagacttggcagaacagctgctggtctattcctgtgaagcttggggtggaagcaactgtctggagctggcggtggaggccacagaccagcatttcatcgcccagcctggggtccagaattttctttctaagcaatggtatggagagatttcccgagacaccaagaactggaagattatcctgtgtctgtttattatacccttggtgggctgtggctttgtatcatttaggaagaaacctgtcgacaagcacaagaagctgctttggtactatgtggcgttcttcacctcccccttcgtggtcttctcctggaatgtggtcttctacatcgccttcctcctgctgtttgcctacgtgctgctcatggatttccattcggtgccacacccccccgagctggtcctgtactcgctggtctttgtcctcttctgtgatgaagtgagacagtggtacgtaaatggggtgaattattttactgacctgtggaatgtgatggacacgctggggcttttttacttcatagcaggaattgtatttcggctccactcttctaataaaagctctttgtattctggacgagtcattttctgtctggactacattattttcactctaagattgatccacatttttactgtaagcagaaacttaggacccaagattataatgctgcagaggatgctgatcgatgtgttcttcttcctgttcctctttgcggwgtggatggtggcctttggcgtggccaggcaagggatccttaggcagaatgagcagcgctggaggtggatattccgttcggtcatctacgagccctacctggccatgttcggccaggtgcccagtgacgtggatggtaccacgtatgactttgcccactgcaccttcactgggaatgagtccaagccactgtgtgtggagctggatgagcacaacctgccccggttccccgagtggatcaccatccccctggtgtgcatctacatgttatccaccaacatcctgctggtcaacctgctggtcgccatgtttggctacacggtgggcaccgtccaggagaacaatgaccaggtctggaagttccagaggtacttcctggtgcaggagtactgcagccgcctcaatatccccttccccttcatcgtcttcgcttacttctacatggtggtgaagaagtgcttcaagtgttgctgcaaggagaaaaacatggagtcttctgtctgctgtttcaaaaatgaagacaatgagactctggcatgggagggtgtcatgaaggaaaactaccttgtcaagatcaacacaaaagccaacgacacctcagaggaaatgaggcatcgatttagacaactggatacaaagcttaatgatctcaagggtcttctgaaagagattgctaataaaatcaaataaaactgtatgaactctaatggagaaaaatctaattatagcaagatcatattaaggaatgctgatgaacaattttgctatcgactactaaatgagagattttcagacccctgggtacatggtggatgattttaaatcaccctagtgtgctgagaccttgagaataaagtgtgaagggcgaattctgcagatatccatcacactggcggccgctcgagcatgcatctagag

SEQ ID NO: 780 - protein, 1095 aa, Homo sapiens
  VARIANT (1)...(1095): Xaa = Any Amino Acid
MRNRRNDTLDSTRTLYSSASRSTDLSYSESDLVNFIQANFKKRECVFFTKDSKATENVCKCGYAQSQHMEGTQINQSEKWNYKKHTKEFPTDAFGDIQFETLGKKGKYIRLSCDTDAEILYELLTQHWHLKTPNLVISVTGGAKNFALKPRMRKIFSRLIYIAQSKGAWILTGGTHYGLMKYIGEVVRDNTISRSSEENIVAIGIAAWGMVSNRDTLIRNCDAEGYFLAQYLMDDFTRDPLYILDNNHTHLLLVDNGCHGHPTVEAKLRNQLEKYISERTIQDSNYGGKIPIVCFAQGGGKETLKAINTSIKNKIPCVVVEGSGQIADVIASLVEVEDALTSSAVKEKLVRFLPRTVSRLPEEETESWIKWLKEILECSHLLTVIKMEEAGDEIVSNAISYALYKAFSTSEQDKDNWNGQLKLLLEWNQLDLANDEIFTNDRRWESADLQEVMFTALIKDRPKFVRLFLENGLNLRKFLTHDVLTELFSNHFSTLVYRNLQIAKNSYNDALLTFVWKLVANFRRGFRKEDRNGRDEMDIELHDVSPITRHPLQALFIWAILQNKKELSKVIWEQTRGCTLAALGASKLLKTLAKVKNDINAAGESEELANEYETRAVELFTECYSSDEDLAEQLLVYSCEAWGGSNCLELAVEATDQHFIAQPGVQNFLSKQWYGEISRDTKNWKIILCLFIIPLVGCGFVSFRKKPVDKHKKLLWYYVAFFTSPFVVFSWNVVFYIAFLLLFAYVLLMDFHSVPHPPELVLYSLVFVLFCDEVRQWYVNGVNYFTDLWNVMDTLGLFYFIAGIVFRLHSSNKSSLYSGRVIFCLDYIIFTLRLIHIFTVSRNLGPKIIMLQRMLIDVFFFLFLFAXWMVAFGVARQGILRQNEQRWRWIFRSVIYEPYLAMFGQVPSDVDGTTYDFAHCTFTGNESKPLCVELDEHNLPRFPEWITIPLVCIYMLSTNILLVNLLVAMFGYTVGTVQENNDQVWKFQRYFLVQEYCSRLNIPFPFIVFAYFYMVVKKCFKCCCKEKNMESSVCCFKNEDNETLAWEGVMKENYLVKINTKANDTSEEMRHRFRQLDTKLNDLKGLLKEIANKIK

SEQ ID NO: 781 - protein, 15 aa, Homo sapiens
RMPTVLQCVNVSVVS

SEQ ID NO: 782 - DNA, 45 bp, Homo sapiens
agaatgcctaccgtgctgcagtgcgtgaacgtgtcggtggtgtct

SEQ ID NO: 783 - DNA, 45 bp, Homo sapiens
gagccagggagccagatggtggaggccagcctctccgtacggcac

SEQ ID NO: 784 - DNA, 45 bp, Homo sapiens
gaggccgaccaagagccagggagccagatggtggaggccagcctc

SEQ ID NO: 785 - DNA, 45 bp, Homo sapiens
ggcctgcacagtcttgaggccgaccaagagccagggagccagatg

SEQ ID NO: 786 - DNA, 45 bp, Homo sapiens
tacaccatcgggctgggcctgcacagtcttgaggccgaccaagag

SEQ ID NO: 787 - DNA, 42 bp, Homo sapiens
ttccagaactcctacaccatcgggctgggcctgcacagtctt

SEQ ID NO: 788 - DNA, 45 bp, Homo sapiens
ctgtcagccgcacactgtttccagaactcctacaccatcgggctg

SEQ ID NO: 789 - DNA, 45 bp, Homo sapiens
catccgcagtgggtgctgtcagccgcacactgtttccagaactcc

SEQ ID NO: 790 - DNA, 45 bp, Homo sapiens
tcgggcgtcctggtgcatccgcagtgggtgctgtcagccgcacac

SEQ ID NO: 791 - DNA, 45 bp, Homo sapiens
aacgaattgttctgctcgggcgtcctggtgcatccgcagtgggtg

SEQ ID NO: 792 - DNA, 45 bp, Homo sapiens
gcactggtcatggaaaacgaattgttctgctcgggcgtcctggtg

SEQ ID NO: 793 - DNA, 51 bp, Homo sapiens
tcgcagccctggcaggcggcactggtcatggaaaacgaattgttctgctcg

SEQ ID NO: 794 - DNA, 45 bp, Homo sapiens
atcagcattgcttcgcagtgccctaccgcggggaactcttgcctc

SEQ ID NO: 795 - DNA, 45 bp, Homo sapiens
tccgtgtccgagtctgacaccatccggagcatcagcattgcttcg

SEQ ID NO: 796 - DNA, 45 bp, Homo sapiens
atcaagttggacgaatccgtgtccgagtctgacaccatccggagc

SEQ ID NO: 797 - DNA, 45 bp, Homo sapiens
aacgacctcatgctcatcaagttggacgaatccgtgtccgagtct

SEQ ID NO: 798 - DNA, 45 bp, Homo sapiens
agacccttgctcgctaacgacctcatgctcatcaagttggacgaa

SEQ ID NO: 799 - protein, 15 aa, Homo sapiens
EPGSQMVEASLSVRH

SEQ ID NO: 800 - protein, 15 aa, Homo sapiens
EADQEPGSQMVEASL

SEQ ID NO: 801 - protein, 15 aa, Homo sapiens
GLHSLEADQEPGSQM

SEQ ID NO: 802 - protein, 15 aa, Homo sapiens
YTIGLGLHSLEADQE

SEQ ID NO: 803 - protein, 14 aa, Homo sapiens
FQNSYTIGLGLHSL

SEQ ID NO: 804 - protein, 15 aa, Homo sapiens
LSAAHCFQNSYTIGL

SEQ ID NO: 805 - protein, 15 aa, Homo sapiens
HPQWVLSAAHCFQNS

SEQ ID NO: 806 - protein, 15 aa, Homo sapiens
SGVLVHPQWVLSAAH

SEQ ID NO: 807 - protein, 15 aa, Homo sapiens
NELFCSGVLVHPQWV

SEQ ID NO: 808 - protein, 15 aa, Homo sapiens
ALVMENELFCSGVLV

SEQ ID NO: 809 - protein, 17 aa, Homo sapiens
SQPWQAALVMENELFCS

SEQ ID NO: 810 - protein, 15 aa, Homo sapiens
ISIASQCPTAGNSCL

SEQ ID NO: 811 - protein, 15 aa, Homo sapiens
SVSESDTIRSISIAS

SEQ ID NO: 812 - protein, 15 aa, Homo sapiens
IKLDESVSESDTIRS

SEQ ID NO: 813 - protein, 15 aa, Homo sapiens
NDLMLIKLDESVSES

SEQ ID NO: 814 - protein, 15 aa, Homo sapiens
RPLLANDLMLIKLDE

SEQ ID NO: 815 - DNA, 35 bp, Artificial Sequence
  PCR primer
ggaccagcatatgaggaacagaaggaatgacactc

SEQ ID NO: 816 - DNA, 29 bp, Artificial Sequence
  PCR primer
ccgctcgagtccaccccaagcttcacagg

SEQ ID NO: 817 - DNA, 1959 bp, Homo sapiens
atgaggaacagaaggaatgacactctggacagcacccggaccctgtactccagcgcgtctcggagcacagacttgtcttacagtgaaagcgacttggtgaattttattcaagcaaattttaagaaacgagaatgtgtcttctttaccaaagattccaaggccacggagaatgtgtgcaagtgtggctatgcccagagccagcacatggaaggcacccagatcaaccaaagtgagaaatggaactacaagaaacacaccaaggaatttcctaccgacgcctttggggatattcagtttgagacactggggaagaaagggaagtatatacgtctgtcctgcgacacggacgcggaaatcctttacgagctgctgacccagcactggcacctgaaaacacccaacctggtcatttctgtgaccgggggcgccaagaacttcgccctgaagccgcgcatgcgcaagatcttcagccggctcatctacatcgcgcagtccaaaggtgcttggattctcacgggaggcacccattatggcctgatgaagtacatcggggaggtggtgagagataacaccatcagcaggagttcagaggagaatattgtggccattggcatagcagcttggggcatggtctccaaccgggacaccctcatcaggaattgcgatgctgagggctattttttagcccagtaccttatggatgacttcacaagagatccactgtatatcctggacaacaaccacacacatttgctgctcgtggacaatggctgtcatggacatcccactgtcgaagcaaagctccggaatcagctagagaagtatatctctgagcgcactattcaagattccaactatggtggcaagatccccattgtgtgttttgcccaaggaggtggaaaagagactttgaaagccatcaatacctccatcaaaaataaaattccttgtgtggtggtggaaggctcgggccagatcgctgatgtgatcgctagcctggtggaggtggaggatgccctgacatcttctgccgtcaaggagaagctggtgcgctttttaccccgcacggtgtcccggctgcctgaggaggagactgagagttggatcaaatggctcaaagaaattctcgaatgttctcacctattaacagttattaaaatggaagaagctggggatgaaattgtgagcaatgccatctcctacgctctatacaaagccttcagcaccagtgagcaagacaaggataactggaatgggcagctgaagcttctgctggagtggaaccagctggacttagccaatgatgagattttcaccaatgaccgccgatgggagtctgctgaccttcaagaagtcatgtttacggctctcataaaggacagacccaagtttgtccgcctctttctggagaatggcttgaacctacggaagtttctcacccatgatgtcctcactgaactcttctccaaccacttcagcacgcttgtgtaccggaatctgcagatcgccaagaattcctataatgatgccctcctcacgtttgtctggaaactggttgcgaacttccgaagaggcttccggaaggaagacagaaatggccgggacgagatggacatagaactccacgacgtgtctcctattactcggcaccccctgcaagctctcttcatctgggccattcttcagaataagaaggaactctccaaagtcatttgggagcagaccaggggctgcactctggcagccctgggagccagcaagcttctgaagactctggccaaagtgaagaacgacatcaatgctgctggggagtccgaggagctggctaatgagtacgagacccgggctgttgagctgttcactgagtgttacagcagcgatgaagacttggcagaacagctgctggtctattcctgtgaagcttggggtggactcgagcaccaccaccaccaccactga

SEQ ID NO: 818 - protein, 652 aa, Homo sapiens
MRNRRNDTLDSTRTLYSSASRSTDLSYSESDLVNFIQANFKKRECVFFTKDSKATENVCKCGYAQSQHMEGTQINQSEKWNYKKHTKEFPTDAFGDIQFETLGKKGKYIRLSCDTDAEILYELLTQHWHLKTPNLVISVTGGAKNFALKPRMRKIFSRLIYIAQSKGAWILTGGTHYGLMKYIGEVVRDNTISRSSEENIVAIGIAAWGMVSNRDTLIRNCDAEGYFLAQYLMDDFTRDPLYILDNNHTHLLLVDNGCHGHPTVEAKLRNQLEKYISERTIQDSNYGGKIPIVCFAQGGGKETLKAINTSIKNKIPCVVVEGSGQIADVIASLVEVEDALTSSAVKEKLVRFLPRTVSRLPEEETESWIKWLKEILECSHLLTVIKMEEAGDEIVSNAISYALYKAFSTSEQDKDNWNGQLKLLLEWNQLDLANDEIFTNDRRWESADLQEVMFTALIKDRPKFVRLFLENGLNLRKFLTHDVLTELFSNHFSTLVYRNLQIAKNSYNDALLTFVWKLVANFRRGFRKEDRNGRDEMDIELHDVSPITRHPLQALFIWAILQNKKELSKVIWEQTRGCTLAALGASKLLKTLAKVKNDINAAGESEELANEYETRAVELFTECYSSDEDLAEQLLVYSCEAWGGLEHHHHHH

SEQ ID NO: 819 - protein, 132 aa, Homo sapien
TAASDNFQLSQGGQGFAIPIGQAMAIAGQIRSGGGSPTVHIGPTAFLGLGVVDNNGNGARVQRVVGSAPAASLGISTGDVITAVDGAPINSATAMADALNGHHPGDVISVNWQTKSGGTRTGNVTLAEGPPA

SEQ ID NO: 820 - DNA, 36 bp, Artificial Sequence
  PCR primer
ggggaattcatgatccgggagaaatttgcccactgc

SEQ ID NO: 821 - DNA, 33 bp, Artificial Sequence
  PCR primer
gggctcgagtcaggagtttgagaccagcctggc

SEQ ID NO: 822 - DNA, 675 bp, Homo sapiens
atgcatcaccatcaccatcacacggccgcgtccgataacttccagctgtcccagggtgggcagggattcgccattccgatcgggcaggcgatggcgatcgcgggccagatcaagcttcccaccgttcatatcgggcctaccgccttcctcggcttgggtgttgtcgacaacaacggcaacggcgcacgagtccaacgcgtggtcgggagcgctccggcggcaagtctcggcatctccaccggcgacgtgatcaccgcggtcgacggcgctccgatcaactcggccaccgcgatggcggacgcgcttaacgggcatcatcccggtgacgtcatctcggtgacctggcaaaccaagtcgggcggcacgcgtacagggaacgtgacattggccgagggacccccggccgaattcatgatccgggagaaatttgcccactgcaccgtgctaaccattgcacacagattgaacaccattattgacagcgacaagataatggttttagattcaggaagactgaaagaatatgatgagccgtatgttttgctgcaaaataaagagagcctattttacaagatggtgcaacaactgggcaaggcagaagccgctgccctcactgaaacagcaaaacagagatggggtttcaccatgttggccaggctggtctcaaactcctga

SEQ ID NO: 823 - DNA, 291 bp, Homo sapiens
atggggatccgggagaaatttgcccactgcaccgtgctaaccattgcacacagattgaacaccattattgacagcgacaagataatggttttagattcaggaagactgaaagaatatgatgagccgtatgttttgctgcaaaataaagagagcctattttacaagatggtgcaacaactgggcaaggcagaagccgctgccctcactgaaacagcaaaacagagatggggtttcaccatgttggccaggctggtctcaaactccctcgagcaccaccaccaccaccactga

SEQ ID NO: 824 - DNA, 1074 bp, Homo sapiens
atgtcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatacgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatacagagaatgtcccagttacactatcagaggagaaccgttctgaaggaaaagttggttttcaggcctataagaattacttcagagctggtgctcactggattgtcttcattttccttattctcgagcaccaccaccaccaccactga

SEQ ID NO: 825 - protein, 224 aa, Homo sapiens
MHHHHHHTAASDNFQLSQGGQGFAIPIGQAMAIAGQIKLPTVHIGPTAFLGLGVVDNNGNGARVQRVVGSAPAASLGISTGDVITAVDGAPINSATAMADALNGHHPGDVISVTWQTKSGGTRTGNVTLAEGPPAEFMIREKFAHCTVLTIAHRLNTIIDSDKIMVLDSGRLKEYDEPYVLLQNKESLFYKMVQQLGKAEAAALTETAKQRWGFTMLARLVSNS

SEQ ID NO: 826 - protein, 357 aa, Homo sapiens
MSAIERVSEAIVSIRRIQTFLLLDEISQRNRQLPSDGKKMVHVQDFTAFWDKASETPTLQGLSFTVRPGELLAVVGPVGAGKSSLLSAVLGELAPSHGLVSVHGRIAYVSQQPWVFSGTLRSNILFGKKYEKERYEKVIKACALKKDLQLLEDGDLTVIGDRGTTLSGGQKARVNLARAVYQDADIYLLDDPLSAVDAEVSRHLFELCICQILHEKITILVTHQLQYLKAASQILILKDGKMVQKGTYTEFLKSGIDFGSLLKKDNEESEQPPVPGTPTLRNRTFSESSVWSQQSSRPSLKDGALESQDTENVPVTLSEENRSEGKVGFQAYKNYFRAGAHWIVFIFLILEHHHHHH

SEQ ID NO: 827 - protein, 96 aa, Homo sapiens
MGIREKFAHCTVLTIAHRLNTIIDSDKIMVLDSGRLKEYDEPYVLLQNKESLFYKMVQQLGKAEAAALTETAKQRWGFTMLARLVSNSLEHHHHHH

SEQ ID NO: 828 - DNA, 35 bp, Artificial Sequence
  PCR primer
cgcccatggggatccgggagaaatttgcccactgc

SEQ ID NO: 829 - DNA, 35 bp, Artificial Sequence
  PCR primer
cgcctcgagggagtttgagaccagcctggccaaca

SEQ ID NO: 830 - DNA, 38 bp, Artificial Sequence
  PCR primer
gcatggaccatatgtcagccattgagagggtgtcagag

SEQ ID NO: 831 - DNA, 34 bp, Artificial Sequence
  PCR primer
ccgctcgagaataaggaaaatgaagacaatccag

SEQ ID NO: 832 - DNA, 27 bp, Artificial Sequence
  PCR primer
gttgaattcatgcacgggccccaggtg

SEQ ID NO: 833 - DNA, 30 bp, Artificial Sequence
  PCR primer
cccctcgagtcactatggtctgcctcttga

SEQ ID NO: 834 - DNA, 915 bp, Homo sapiens
atgcatcaccatcaccatcacacggccgcgtccgataacttccagctgtcccagggtgggcagggattcgccattccgatcgggcaggcgatggcgatcgcgggccagatcaagcttcccaccgttcatatcgggcctaccgccttcctcggcttgggtgttgtcgacaacaacggcaacggcgcacgagtccaacgcgtggtcgggagcgctccggcggcaagtctcggcatctccaccggcgacgtgatcaccgcggtcgacggcgctccgatcaactcggccaccgcgatggcggacgcgcttaacgggcatcatcccggtgacgtcatctcggtgacctggcaaaccaagtcgggcggcacgcgtacagggaacgtgacattggccgagggacccccggccgaattcatgcacgggccccaggtgctggcacgctgctccgagtgtgcttgtcctgccttggctgccacctctgcgggggtgcgtctggagggggtggaccggccaccaaccttacccagtcaaggaagtggatggccatgttcccacagcctgagtggctgccacctgatggctgatggagcaaaggccttaggaaaagcagatggcccttggccctacctttttgttagaagaactgatgttccatgtcctgcagcgagtgaggttggtggctgtgcccccagctcctggcgcgccctcgcagaggtgactggttgctctttgggccctcttggccttgcccagcatgcacaagcctcagtgctactactgtgctacaaatggagccatataggggaaacgagcagccatctcaggagcaaggtgtatgctgcctttgggggctccagtccttgcctcaagggtcttatgtcactgtgggcttcttggttgtcaagaggcagaccatag

SEQ ID NO: 835 - protein, 304 aa, Homo sapiens [sequence omitted]

SEQ ID NO: 836 - DNA, 24 bp, Artificial Sequence
  PCR primer
cgaagtcacgtggaggccagcctc

SEQ ID NO: 837 - DNA, 29 bp, Artificial Sequence
  PCR primer
cctgaccgaattcattaactggcctggac

SEQ ID NO: 838 - protein, 166 aa, Homo sapiens
  VARIANT (1)...(166): Xaa = Any Amino Acid
MGHHHHHHVEASLSVRHPEYNRPLLANDLMLIKLDESVSESDTIRSISIASQCPTAGNSCLVSGWGLLANGRMPTVLQCVNVSVVSEEVCSKLYDPLYHPSMFCAGGGQXQXDSCNGDSGGPLICNGYLQGLVSFGKAPCGQVGVPGVYTNLCKFTEWIEKTVQAS

SEQ ID NO: 839 - DNA, 504 bp, Homo sapiens
  misc_feature (1)...(504): n = A,T,C or G
atgggccatcatcatcatcatcacgtggaggccagcctctccgtacggcacccagagtacaacagacccttgctcgctaacgacctcatgctcatcaagttggacgaatccgtgtccgagtctgacaccatccggagcatcagcattgcttcgcagtgccctaccgcggggaactcttgcctcgtttctggctggggtctgctggcgaacggcagaatgcctaccgtgctgcagtgcgtgaacgtgtcggtggtgtctgaggaggtctgcagtaagctctatgacccgctgtaccaccccagcatgttctgcgccggcggagggcaanaccagaangactcctgcaacggtgactctggggggcccctgatctgcaacgggtacttgcagggccttgtgtctttcggaaaagccccgtgtggccaagttggcgtgccaggtgtctacaccaacctctgcaaattcactgagtggatagagaaaaccgtccaggccagttaatga

SEQ ID NO: 840 - DNA, 21 bp, Artificial Sequence
  PCR primer
ctcagggttccggagccgcgg

SEQ ID NO: 841 - DNA, 35 bp, Artificial Sequence
  PCR primer
ctatagaattcattaccaaaaagctgggctccagc

SEQ ID NO: 842 - protein, 241 aa, Homo sapiens
MQHHHHHHLRVPEPRPGEAKAEGAAPPTPSKPLTSFLIQDILRDGAQRQGGRTSSQRQRDPEPEPEPEPEGGRSRAGAQNDQLSTGPRAAPEEAETLAETEPERHLGSYLLDSENTSGALPRLPQTPKQPQKRSRAAFSHTQVIELERKFSHQKYLSAPERAHLAKNLKLTETQVKIWFQNRRYKTKRKQLSSELGDLEKHSSLPALKEEAFSRASLVSVYNSYPYYPYLYCVGSWSPAFW

SEQ ID NO: 843 - DNA, 729 bp, Homo sapiens
atgcagcatcaccaccatcaccacctcagggttccggagccgcggcccggggaggcgaaagcggagggggccgcgccgccgaccccgtccaagccgctcacgtccttcctcatccaggacatcctgcgggacggcgcgcagcggcaaggcggccgcacgagcagccagagacagcgcgacccggagccggagccagagccagagccagagggaggacgcagccgcgccggggcgcagaacgaccagctgagcaccgggccccgcgccgcgccggatgaggccgagacgctggcagagaccgagccagaaaggcacttggggtcttatctgttggactctgaaaacacttcaggcgcccttccaaggcttccccaaacccctaagcagccgcagaagcgctcccgagctgccttctcccacactcaggtgatcgagttggagaggaagttcagccatcagaagtacctgtcggcccctgaacgggcccacctggccaagaacctcaagctcacggagacccaagtgaagatatggttccagaacagacgctataagactaagcgaaagcagctctcctcggagctgggagacttggagaagcactcctttttgccggccctgaaagaggaggccttctcccgggcctccctggtctccgtgtataacagctatccttactacccatacctgcactgcgtgggcagctggagcccagctttttggtaatga

SEQ ID NO: 844 - DNA, 27 bp, Artificial Sequence
  PCR primer
ctactaagcgctggagtgagggatcag

SEQ ID NO: 845 - DNA, 33 bp, Artificial Sequence
  PCR primer
catcgagaattcactactctctgactagatgtc

SEQ ID NO: 846 - protein, 161 aa, Homo sapiens [sequence omitted]

SEQ ID NO: 847 - DNA, 489 bp, Homo sapiens
atgcagcatcaccaccatcaccacgctggagtgagggatcaggggcagggcgcgagatggcctcacacagggaagagagggcccctcctgcagggcctcacctgggccacaggaggacactgcttttcctctgaggagtcaggagctgtggatggtgctggacagaagaaggacagggcctggctcaggtgtccagaggctgtcgctggcttccctttgggatcagactgcagggagggagggcggcagggttgtggggggagtgacgatgaggatgacctgggggtggctccaggccttgcccctgcctgggccctcacccagcctccctcacagtctcctggccctcagtctctcccctccactccatcctccatctggcctcagtgggtcattctgatcactgaactgaccatacccagccctgcccacggccctccatggctccccaatgccctggagaggggacatctagtcagagagtagtga

SEQ ID NO: 848 - protein, 132 aa, Homo sapiens; identical to SEQ ID NO: 819

SEQ ID NO: 849 - DNA, 31 bp, Artificial Sequence
  PCR primer
ggggaattcatcacctatgtgccgcctctgc

SEQ ID NO: 850 - DNA, 40 bp, Artificial Sequence
  PCR primer
gggctcgagtcactcgcccacgaaatccgtgtaaaacagc

SEQ ID NO: 851 - DNA, 1203 bp, Homo sapiens
atgcatcaccatcaccatcacacggccgcgtccgataacttccagctgtcccagggtgggcagggattcgccattccgatcgggcaggcgatggcgatcgcgggccagatcaagcttcccaccgttcatatcgggcctaccgccttcctcggcttgggtgttgtcgacaacaacggcaacggcgcacgagtccaacgcgtggtcgggagcgctccggcggcaagtctcggcatctccaccggcgacgtgatcaccgcggtcgacggcgctccgatcaactcggccaccgcgatggcggacgcgcttaacgggcatcatcccggtgacgtcatctcggtgacctggcaaaccaagtcgggcggcacgcgtacagggaacgtgacattggccgagggacccccggccgaattcatcacctatgtgccgcctctgctgctggaagtgggggtagaggagaagttcatgaccatggtgctgggcattggtccagtgctgggcctggtctgtgtcccgctcctaggctcagccagtgaccactggcgtggacgctatggccgccgccggcccttcatctgggcactgtccttgggcatcctgctgagcctctttctcatcccaagggccggctggctagcagggctgctgtgcccggatcccaggcccctggagctggcactgctcatcctgggcgtggggctgctggacttctgtggccaggtgtgcttcactccactggaggccctgctctctgacctcttccgggacccggaccactgtcgccaggcctactctgtctatgccttcatgatcagtcttgggggctgcctgggctacctcctgcctgccattgactgggacaccagtgccctggccccctacctgggcacccaggaggagtgcctctttggcctgctcaccctcatcttcctcacctgcgtagcagccacactgctggtggctgaggaggcagcgctgggccccaccgagccagcagaagggctgtcggccccctccttgtcgccccactgctgtccatgccgggcccgcttggctttccggaacctgggcgccctgcttccccggctgcaccagctgtgctgccgcatgccccgcaccctgcgccggctcttcgtggctgagctgtgcagctggatggcactcatgaccttcacgctgttttacacggatttcgtgggcgagtga

SEQ ID NO: 852 - protein, 400 aa, Homo sapiens [sequence omitted]

SEQ ID NO: 853 - protein, 20 aa, Homo sapiens
LLPPPPALCGASACDVSVRV

SEQ ID NO: 854 - DNA, 60 bp, Homo sapiens
ctgctcccacctccacccgcgctctgcggggcctctgcctgtgatgtctccgtacgtgtg

SEQ ID NO: 855 - protein, 10 aa, Homo sapiens
ASACDVSVRV

SEQ ID NO: 856 - DNA, 30 bp, Homo sapiens
gcctctgcctgtgatgtctccgtacgtgtg

SEQ ID NO: 857 - protein, 9 aa, Homo sapiens
ASACDVSVR

SEQ ID NO: 858 - protein, 9 aa, Homo sapiens
SACDVSVRV

SEQ ID NO: 859 - DNA, 27 bp, Homo sapiens
tctgcctgtgatgtctccgtacgtgtg

SEQ ID NO: 860 - protein, 19 aa, Homo sapiens
GIGPVLGLVCVPLLGSASD

SEQ ID NO: 861 - protein, 19 aa, Homo sapiens
VPPLLLEVGVEEKFMTMVL

SEQ ID NO: 862 - protein, 19 aa, Homo sapiens
MVQRLWVSRLLRHRKAQLL

SEQ ID NO: 863 - DNA, 57 bp, Homo sapiens
  misc_feature (1)...(57): n = A,T,C or G
ggnathggnccngtnytnggnytngtntgygtnccnytnytnggnwsngcnwsngay

SEQ ID NO: 864 - DNA, 57 bp, Homo sapiens
  misc_feature (1)...(57): n = A,T,C or G
gtnccnccnytnytnytngargtnggngtngargaraarttyatgacnatggtnytn

SEQ ID NO: 865 - DNA, 57 bp, Homo sapiens
  misc_feature (1)...(57): n = A,T,C or G
atggtncarmgnytntgggtnwsnmgnytnytnmgncaymgnaargcncarytnytn

SEQ ID NO: 866 - protein, 9 aa, Homo sapiens
VLQCVNVSV

SEQ ID NO: 867 - protein, 9 aa, Homo sapiens
RMPTVLQCV

SEQ ID NO: 868 - protein, 9 aa, Homo sapiens
NLCKFTEWI

SEQ ID NO: 869 - protein, 9 aa, Homo sapiens
MLIKLDESV

SEQ ID NO: 870 - protein, 9 aa, Homo sapiens
LLANDLMLI

SEQ ID NO: 871 - protein, 10 aa, Homo sapiens
LLANGRMPTV

SEQ ID NO: 872 - protein, 10 aa, Homo sapiens
LMLIKLDESV

SEQ ID NO: 873 - protein, 10 aa, Homo sapiens
VLQCVNVSVV

SEQ ID NO: 874 - protein, 10 aa, Homo sapiens
GLLANGRMPT

SEQ ID NO: 875 - protein, 10 aa, Homo sapiens
TVLQCVNVSV

SEQ ID NO: 876 - protein, 9 aa, Homo sapiens
GVLVHPQWV

SEQ ID NO: 877 - protein, 9 aa, Homo sapiens
VLVHPQWVL

SEQ ID NO: 878 - DNA, 1195 bp, Homo sapiens
ccgagactcacggtcaagctaaggcgaagagtgggtggctgaagccatactattttatagaattaatggaaagcagaaaagacatcacaaaccaagaagaactttggaaaatgaagcctaggagaaatttagaagaagacgattatttgcataaggacacgggagagaccagcatgctaaaaagacctgtgcttttgcatttgcaccaaacagcccatgctgatgaatttgactgcccttcagaacttcagcacacacaggaactctttccacagtggcacttgccaattaaaatagctgctattatagcatctctgacttttctttacactcttctgagggaagtaattcaccctttagcaacttcccatcaacaatatttttataaaattccaatcctggtcatcaacaaagtcttgccaatggtttccatcactctcttggcattggtttacctgccaggtgtgatagcagcaattgtccaacttcataatggaaccaagtataagaagtttccacattggttggataagtggatgttaacaagaaagcagtttgggcttctcagtttcttttttgctgtactgcatgcaatttatagtctgtcttacccaatgaggcgatcctacagatacaagttgctaaactgggcatatcaacaggtccaacaaaataaagaagatgcctggattgagcatgatgtttggagaatggagatttatgtgtctctgggaattgtgggattggcaatactggctctgttggctgtgacatctattccatctgtgagtgactctttgacatggagagaatttcactatattcagagcaagctaggaattgtttcccttctactgggcacaatacacgcattgatttttgcctggaataagtggatagatataaaacaatttgtatggtatacacctccaacttttatgatagctgttttccttccaattgttgtcctgatatttaaaagcatactattcctgccatgcttgaggaagaagatactgaagattagacatggttgggaagacgtcaccaaaattaacaaaactgagatatgttcccagttgtagaattactgtttacacacatttttgttcaatattgatatattttatcaccaacatttcaagtttgtatttgttaataaaatgattattcaaggaaaaaaaaaaaaaaaaaa

SEQ ID NO: 879 - protein, 339 aa, Homo sapiens
MESRKDITNQEELWKMKPRRNLEEDDYLHKDTGETSMLKRPVLLHLHQTAHADEFDCPSELQHTQELFPQWHLPIKIAAIIASLTFLYTLLREVIHPLATSHQQYFYKIPILVINKVLPMVSITLLALVYLPGVIAAIVQLHNGTKYKKFPHWLDKWMLTRKQFGLLSFFFAVLHAIYSLSYPMRRSYRYKLLNWAYQQVQQNKEDAWIEHDVWRMEIYVSLGIVGLAILALLAVTSIPSVSDSLTWREFHYIQSKLGIVSLLLGTIHALIFAWNKWIDIKQFVWYTPPTFMIAVFLPIVVLIFKSILFLPCLRKKILKIRHGWEDVTKINKTEICSQL

SEQ ID NO: 880 - DNA, 2172 bp, Homo sapiens
aaaattgaatattgagataccattctttagtgttaccttttttacccacatgtgtttctgaaaatattggaattttattcatcttaaaaattggacccggccttatttaccatctttaatccattttagtactatgggtgagtacatggaattgaagtctggcttaaatcttcagaaagttatatatctattttattttatttttttgagacagagtctcgctgtgtcacccaggctggagtgcggtgccacaatcttggctcactgcaacctctgagtcccaggttcaagcgatactcatgcctcggcctcctgagtagctgggactacaggcgtgcaccaccacatctggctaatctttttttgtatttttagtagagacggggtttcactgtggtctccatctcctgacctcgtgatccgcctgcctcccaaagtgctgggattacaggcatgagccaccgcacacagctgggactgggtaatttataaagaaaagaggtttaatgactcacagttccgcatggctggagaggcctcaggaaacttacaatcatggtggaaggcgaaggggaagcaaggcacgtcttacatggtggcaggagagaacgagtgaggggggagactgccacaaactttttttttttgagacaagagtctggccctgttgcccaggctggagtgcagtggcatgatctcagctcactgcaacctctgcctcacaggttcaagcaattctcatgcctcagcctcccgcatagctgggaccacaggtatgcaccaccacacctagctaatttttgtagttttagtagagatggggtctcactatgttgctcaggctggtctaaaactcctgggctccagcaatccgcctgccttggcctcccaaagtgctggggttacaggcataagccaccacatccagcctgccacatacttttaaactatcaggtctcatgagaactcatgcactatcacaagaatagcatggggaaaatcccccccataatccaatcacctcccaccaggtctcctccgacacgtgggattgggtggggacacagagccaaaccgtatcagatgctgcaggggctggggacactgagaccactcagacctggtgtctctgtcactcttctgggctctgtctgtctccaggacctccctccccttccatggtatagaaggaaagtgctgtaaggtgcaaattgcacaggaactccttaagacatacatcatccactcagcagttttaggttcgcagcaaaatggagtggaaggaacagaaatttcctgtgcacccctccccgctgtctccgccatatcggcatcctgcatccagagtggtggactggttacaggctatgaacctacactgatgcggcaccaccacccagagtccacgggttatgttggttcacatttactcttgctgtggtatggtctataggtttggacagatgtccgataatcctttttacattttggcatccttgggtagctcgtcttgtaggaatggacttgcttcaaagtggaggcaggcagatccttcagacgggtatatggagccctgttttcagttgcttttctaattctctcttatcgtttacctcaaaatcttcctgaggtctcgcttccttttaaaatccttgtctactttgcagcatcactctgacactccattgattcctcagcacctactgactacacggttaggagtgcaagggtagaattcatgttttattcatctttgggtctgtagcacccagcaaagtgctcagtaaatgcgcagtaattgatttgacctctgaacaaatacacactgtactaagaatctacacaccgaaagacaaaaacaagacaaatttgagtgctacaggtgtcacgcttggcatcacacatgtgcctgtgtattcctctaggtggttaccaggagctctgccactgcatgtccactagtgacgggttcgctccaccaccccagctgggtagccgctgctctcacataaggggtccaattaaaattgccaggaataaattcccccggactttgacttctcaagagctaagaaggtttgctgagtattctggcatgatgtttggtgatcaaacaactgctggccaaaaatgatgagtatttccccctcttgctgaagatgtgctccatac

SEQ ID NO: 881 - DNA, 2455 bp, Homo sapiens
cagcttaaaaatggtttcttgaaatcagtgattagcattcactcaccagtacccctactaaggggtaggcactggtttgtactcctgggaatacaggagtacaccagaatttatttctgcttattgcttttgttgcaaatgccgtggcttcatctgaggaattctagaattcagagggtgtagccctccactctgctgtcttgctatctgctctcattgcatccgtttaacctgcattctgaaagatgtttctcaggtttttccttgacgattttcttcttttctgattctgacaatgttttaaatcattgtactgtggttatcatttctctgcatttattttacccatcttcctttgtaacttgtcctattgtcttttaatttctgcctgttctttatggctttcaacttcataaataacatgttttctcaaatctctttgtgaattccagagagggccaggcacggtggctcacatctgtaatcccagcactttggggaggctgagacgggtggatcacttgaggtcaggagtttgagaccagcctggccaacatggtgaaatcccgtttcactaaaaatacaaaaattacccaggcatggtggcgggcgcctgtaatcccaggtactcgggaggctgagggaggagaatcgcttgaacctgggaggctgagggaggagaatcgcttgaacccgggaggcagaggttgcagtgaaccgagatcatgttgctgcactccagcctggtcaacagagcaagactctgcctcaaaaacaaacaaataaacaaacaaacaaacaaaacagagagattttgctgcaatgtacaaggagcaatttgctcctttaaaaaaataatttttggccaggcacagtggctcacacctgtaatcccagcactttgggaagccaaggtgggtggatcatttgaggtcaggagtttgagatcagcctggccaacatggtgaaacactatctctattaaaaatacaaaaatgtgctcagtgtggtggtgcacatctgtaatctcagcctcccgcatagctgggaccacaggtatgcaccaccacacctagctaatttttgtagttttagtagagatggggtctcactatgttgctcaggctggtctaaaactcctgggctccagcaatccgcctgccttggcctcccaaagtgctggggttacaggcataagccaccacatccagcctgccacatacttttaaactatcaggtctcatgagaactcatgcactatcacaagaatagcatggggaaaatcccccccataatccaatcacctcccaccaggtctcctccgacacgtgggattgggtggggacacagagccaaaccgtatcagatgctgcaggggctggggacactgagaccactcagacctggtgtctctgtcactcttctgggctctgtctgtctccaggacctccctccccttccatggtatagaaggaaagtgctgtaaggtgcaaattgcacaggaactccttaagacatacatcatccactcagcagttttaggttcgcagcaaaatggagtggaaggaacagaaatttcctgtgcacccctccccgctgtctccgccatatcggcatcctgcatccagagtggtggactggttacaggctatgaacctacactgatgcggcaccaccacccagagtccacaggttatgttggttcacatttactcttgctgtggtatggtctataggtttggacagatgtccgataatcctttttacattttggcatccttgggtagctcgtcttgtaggaatggacttgcttcaaagtggaggcaggcagatccttcagacgggtatatggagccctgttttcagttgcttttctaattctctcttatcgtttacctcaaaatcttcctgaggtctcgcttccttttaaaatccttgtctactttgcagcatcactctgacactccattgattcctcagcacctactgactacacggttaggagtgcaagggtagaattcatgttttattcatctttgggtctgtagcacccagcaaagtgctcagtaaatgcgcagtaattgatttgacctctgaacaaatacacactgtactaagaatctacacaccgaaagacaaaaacaagacaaatttgagtgctacaggtgtcacgcttggcatcacacatgtgcctgtgtattcctctaggtggttaccaggagctctgccactgcatgtccactagtgacgggttcgctccaccaccccagctgggtagccgctgctctcacataaggggtccaattaaaattgccaggaataaattcccccggactttgacttctcaagagctaagaaggtttgctgagtattctggcatgatgtttggtgatcaaacaactgctggccaaaaatgatgagtatttccccctcttgctgaagatgtgctccatac

SEQ ID NO: 882 - DNA, 2455 bp, Homo sapiens; identical to SEQ ID NO: 881

SEQ ID NO: 883 - protein, 62 aa, Homo sapiens; identical to SEQ ID NO: 574

SEQ ID NO: 884 - protein, 135 aa, Homo sapiens [sequence omitted]

SEQ ID NO: 885 - protein, 77 aa, Homo sapiens
MHYHKNSMGKIPPIIQSPPTRSPPTRGIGWGHRAKPYQMLQGLGTLRPLRPGVSVTLLGSVCLQDLPPLPWYRRKVL

SEQ ID NO: 886 - protein, 60 aa, Homo sapiens; identical to SEQ ID NO: 586

SEQ ID NO: 887 - protein, 76 aa, Homo sapiens; identical to SEQ ID NO: 584

SEQ ID NO: 888 - protein, 76 aa, Homo sapiens; identical to SEQ ID NO: 575

SEQ ID NO: 889 - protein, 80 aa, Homo sapiens [sequence omitted]

SEQ ID NO: 890 - protein, 72 aa, Homo sapiens
MHYHKNSMGKIPPHNPITSHQVSSDTWDWVGTQSQTVSDAAGAGDTETTQTWCLCHSSGLCLSPGPPSPSMV

SEQ ID NO: 891 - protein, 77 aa, Homo sapiens; identical to SEQ ID NO: 885

SEQ ID NO: 892 - protein, 60 aa, Homo sapiens; identical to SEQ ID NO: 586

SEQ ID NO: 893 - protein, 76 aa, Homo sapiens; identical to SEQ ID NO: 584

SEQ ID NO: 894 - DNA, 2479 bp, Homo sapiens
gtcatattgaacattccagatacctatcattactcgatgctgttgataacagcaagatggctttgaactcagggtcaccaccagctattggaccttactatgaaaaccatggataccaaccggaaaacccctatcccgcacagcccactgtggtccccactgtctacgaggtgcatccggctcagtactacccgtcccccgtgccccagtacgccccgagggtcctgacgcaggcttccaaccccgtcgtctgcacgcagcccaaatccccatccgggacagtgtgcacctcaaagactaagaaagcactgtgcatcaccttgaccctggggaccttcctcgtgggagctgcgctggccgctggcctactctggaagttcatgggcagcaagtgctccaactctgggatagagtgcgactcctcaggtacctgcatcaacccctctaactggtgtgatggcgtgtcacactgccccggcggggaggacgagaatcggtgtgttcgcctctacggaccaaacttcatccttcagatgtactcatctcagaggaagtcctggcaccctgtgtgccaagacgactggaacgagaactacgggcgggcggcctgcagggacatgggctataagaataatttttactctagccaaggaatagtggatgacagcggatccaccagctttatgaaactgaacacaagtgccggcaatgtcgatatctataaaaaactgtaccacagtgatgcctgttcttcaaaagcagtggtttctttacgctgtttagcctgcggggtcaacttgaactcaagccgccagagcaggatcgtgggcggtgagagcgcgctcccgggggcctggccctggcaggtcagcctgcacgtccagaacgtccacgtgtgcggaggctccatcatcacccccgagtggatcgtgacagccgcccactgcgtggaaaaacctcttaacaatccatggcattggacggcatttgcggggattttgagacaatctttcatgttctatggagccggataccaagtacaaaaagtgatttctcatccaaattatgactccaagaccaagaacaatgacattgcgctgatgaagctgcagaagcctctgactttcaacgacctagtgaaaccagtgtgtctgcccaacccaggcatgatgctgcagccagaacagctctgctggatttccgggtggggggccaccgaggagaaagggaagacctcagaagtgctgaacgctgccaaggtgcttctcattgagacacagagatgcaacagcagatatgtctatgacaacctgatcacaccagccatgatctgtgccggcttcctgcaggggaacgtcgattcttgccagggtgacagtggagggcctctggtcacttcgaacaacaatatctggtggctgataggggatacaagctggggttctggctgtgccaaagcttacagaccaggagtgtacgggaatgtgatggtattcacggactggatttatcgacaaatgaaggcaaacggctaatccacatggtcttcgtccttgacgtcgttttacaagaaaacaatggggctggttttgcttccccgtgcatgatttactcttagagatgattcagaggtcacttcatttttattaaacagtgaacttgtctggctttggcactctctgccatactgtgcaggctgcagtggctcccctgcccagcctgctctccctaaccccttgtccgcaaggggtgatggccggctggttgtgggcactggcggtcaattgtggaaggaagagggttggaggctgcccccattgagatcttcctgctgagtcctttccaggggccaattttggatgagcatggagctgtcacttctcagctgctggatgacttgagatgaaaaaggagagacatggaaagggagacagccaggtggcacctgcagcggctgccctctggggccacttggtagtgtccccagcctacttcacaaggggattttgctgatgggttcttagagccttagcagccctggatggtggccagaaataaagggaccagcccttcatgggtggtgacgtggtagtcacttgtaaggggaacagaaacatttttgttcttatggggtgagaatatagacagtgcccttggtgcgagggaagcaattgaaaaggaacttgccctgagcactcctggtgcaggtctccacctgcacattgggtggggctcctgggagggagactcagccttcctcctcatcctccctgaccctgctcctagcaccctggagagtgaatgccccttggtccctggcagggcgccaagtttggcaccatgtcggcctcttcaggcctgatagtcattggaaattgaggtccatgggggaaatcaaggatgctcagtttaaggtacactgtttccatgttatgtttctacacattgatggtggtgaccctgagttcaaagccatctt

SEQ ID NO: 895 - protein, 492 aa, Homo sapiens
MALNSGSPPAIGPYYENHGYQPENPYPAQPTVVPTVYEVHPAQYYPSPVPQYAPRVLTQASNPVVCTQPKSPSGTVCTSKTKKALCITLTLGTFLVGAALAAGLLWKFMGSKCSNSGIECDSSGTCINPSNWCDGVSHCPGGEDENRCVRLYGPNFILQMYSSQRKSWHPVCQDDWNENYGRAACRDMGYKNNFYSSQGIVDDSGSTSFMKLNTSAGNVDIYKKLYHSDACSSKAVVSLRCLACGVNLNSSRQSRIVGGESALPGAWPWQVSLHVQNVHVCGGSIITPEWIVTAAHCVEKPLNNPWHWTAFAGILRQSFMFYGAGYQVQKVISHPNYDSKTKNNDIALMKLQKPLTFNDLVKPVCLPNPGMMLQPEQLCWISGWGATEEKGKTSEVLNAAKVLLIETQRCNSRYVYDNLITPAMICAGFLQGNVDSCQGDSGGPLVTSNNNIWWLIGDTSWGSGCAKAYRPGVYGNVMVFTDWIYRQMKANG

What is claimed:

1. An isolated polypeptide comprising an amino acid sequence having at least 99% identity over the entire length of the sequence set forth in SEQ ID NO:538.

2. A fusion protein comprising at least one polypeptide according to claim 1.

* * * * *